US009683268B2

(12) United States Patent
Barouch et al.

(10) Patent No.: US 9,683,268 B2
(45) Date of Patent: Jun. 20, 2017

(54) VIRUSES ASSOCIATED WITH IMMUNODEFICIENCY AND ENTEROPATHY AND METHODS USING SAME

(71) Applicants: BETH ISRAEL DEACONESS MEDICAL CENTER, INC., Boston, MA (US); WASHINGTON UNIVERSITY, St. Louis, MI (US)

(72) Inventors: Dan Barouch, Newton, MA (US); Herbert W Virgin, Saint Louis, MO (US); David Wang, Saint Louis, MO (US); Guoyan Zhao, Saint Louis, MO (US); Larissa Thackray, Columbia, IL (US); Scott Handley, Saint Louis, MO (US); Rachel Presti, University City, MO (US)

(73) Assignees: Beth Israel Deaconess, Boston, MA (US); Washington University, Saint Louis, MO (US)

( * ) Notice: Subject to any disclaimer, the term of this patent is extended or adjusted under 35 U.S.C. 154(b) by 0 days.

(21) Appl. No.: 14/429,559

(22) PCT Filed: Sep. 19, 2013

(86) PCT No.: PCT/US2013/060579
§ 371 (c)(1),
(2) Date: Mar. 19, 2015

(87) PCT Pub. No.: WO2014/047261
PCT Pub. Date: Mar. 27, 2014

(65) Prior Publication Data
US 2015/0284814 A1 Oct. 8, 2015

Related U.S. Application Data

(60) Provisional application No. 61/702,952, filed on Sep. 19, 2012.

(51) Int. Cl.
*C12Q 1/70* (2006.01)
*A61K 39/235* (2006.01)
*A61K 39/21* (2006.01)
*C12N 7/00* (2006.01)
*A61K 39/00* (2006.01)

(52) U.S. Cl.
CPC .............. *C12Q 1/703* (2013.01); *C12N 7/00* (2013.01); *A61K 39/00* (2013.01); *C12N 2710/10321* (2013.01); *C12N 2710/20021* (2013.01); *C12N 2710/22021* (2013.01); *C12N 2720/00021* (2013.01); *C12N 2750/14021* (2013.01); *C12N 2750/14121* (2013.01); *C12N 2770/16021* (2013.01); *C12N 2770/32021* (2013.01); *C12N 2770/32321* (2013.01); *C12Q 2600/112* (2013.01); *C12Q 2600/158* (2013.01)

(58) Field of Classification Search
None
See application file for complete search history.

(56) References Cited

U.S. PATENT DOCUMENTS

| 7,247,472 B2 * | 7/2007 | Wilson ................. C07K 14/005 424/93.2 |
|---|---|---|
| 2004/0136963 A1 | 7/2004 | Wilson et al. |
| 2006/0211115 A1 | 9/2006 | Roy et al. |
| 2009/0148830 A1 * | 6/2009 | Jannes ................... C12Q 1/689 435/5 |

OTHER PUBLICATIONS

S. S. Kalter, Vet. Pathol., 1982, 19(57):33-43.*
Nix et al., Journal of Clinical Microbiology, Sep. 2008; 46(9): 2874-2878.*
Abbink, P., et al., Comparative seroprevalence and immunogenicity of six rare serotype recombinant adenovirus vaccine vectors from subgroups B and D., J. Virol. 81, 4654-4663 (2007).
Bailey, C., et al., Emerging and reemerging infectious diseases of nonhuman primates in the laboratory setting., Vet. Pathol., 47(3), 462-481 (2010).
Bench, S.R., et al.,I Metagenomic characterization of Chesapeake Bay virioplankton. Appl. Envir. Microbiol., 73(23), 7629-7641 (Dec. 2007).
Bloom, S.M., et al.. Commensal Bacteroides species induce colitis in host-genotype-specific fashion in a mouse model of inflammatory bowel disease. Cell Host Microbe, 9(5), 390-403 (May 2011).
Cadwell, K.. et al., Virus-plus-susceptibility gene interaction determines Crohn's disease gene Atg16L1 phenotypes in intestine., Cell, 141, 1135-1145 (Jun. 2010).
Farkas, T., et al., Characterization of a rhesus monkey calicivirus representing a new genus of Caliciviridae., J. Virol., 82(11), 5408-5416 (Jun. 2008).
Farkas, et al., Detection of norovirus-, sapovirus- and rhesus enteric calicivirus-specific antibodies in captive juvenile macaques., J. Gen. Virol., 91, 734-738 (2010).
Farkas, T., et al., Genetic diversity and histo-blood group antigen interactions of rhesus enteric caliciviruses., J. Virol., 84(17), 8617-8625 (Sep. 2010).
Félix, M., et al., Natural and experimental infection of Caenorhabditis nematodes by novel viruses related to nodaviruses., PLoS Biol., 9(1), e1000586 (Jan. 2011).
Finkbeiner, S.R. et al., Metagenomic analysis of human diarrhea: viral detection and discovery., PLoS Pathog., 4(2), e1000011(2008).
Handley, S.A., et al., Pathogenic Simian Immunodeficiency Virus Infection is Associated with Expansion of the Enteric Virome., Cell, 151, 253-266 (Oct. 2012).

(Continued)

*Primary Examiner* — Stacy B Chen
(74) *Attorney, Agent, or Firm* — Zackson Law LLC; Saul L. Zackson

(57) ABSTRACT

The present invention relates to previously undescribed viruses that are associated with significant expansion of the virome, immunodeficiency, and enteropathy during lentiviral infection. The invention also provides methods to detect acquired immune deficiency syndrome (AIDS) or AIDS progression in a subject, methods to diagnose immunodeficiency or enteropathy in a subject, and methods to identify a therapeutic agent to treat the same.

7 Claims, 16 Drawing Sheets

(56) References Cited

OTHER PUBLICATIONS

Huson, D.H., et al., Megan analysis of metagenomic data. Genome. Res., 17, 377-386 (2007).
Huson, D.H., et al., Methods for comparative metagenomics., BMC Bioinformatics, 10(Suppl 1), S12 (2009).
Li, W., al., Cd-hit: a fast program for clustering and comparing large sets of protein or nucleotide sequences., Bioinformatics, 22(13) 1658-1659 (2006).
Loh, J. et al., Detection of novel sequences related to African Swine Fever Virus in human serum and sewage., J. Virol. 83(24), 13019-13025 (Dec. 2009).
Loh, J., et al. Identification and sequencing of a novel rodent gammaherpesvirus that establishes acute and latent infection in laboratory mice. J. Virol., 85(6), 2642-2656 (Mar. 2011).
McKenna, M. et al., The macaque gut microbiome in health, lentiviral infection, and chronic enterocolitis, PLoS Pathog. 4(2): e20 (Feb. 2008).
Oberste, M.S., et al.: Molecular phylogeny and proposed classification of the simian picornaviruses., J. Virol., 76(3), 1244-1251 (Feb. 2002).
Oberste, M.S., et al., Complete genome sequences for nine simian enteroviruses., J. Gen. Virol., 88, 3360-3372 (2007).
Phan, T.G., et al., Acute Diarrhea in West African Children: Diverse Enteric Viruses and a Novel Parvovirus Genus., J Virol., 86(20), 11024-11030 (Oct. 2012).
Presti, R.M. et al., Quaranfil, Johnston Atoll, and Lake Chad viruses are novel members of the family Orthomyxoviridae., J. Virol., 83(22), 11599-11606 (Nov. 2009).
Sandler, N.G., et al., Plasma levels of soluble CD14 independently predict mortality in HIV infection., J. Infect. Dis., 203, 780-790 (Mar. 2011).
Sasseville, V.G., et al., Overview of known non-human primate pathogens with potential to affect colonies used for toxicity testing., J. Immunotoxicol., 7(2), 79-92 (2010).
Virgin, H.W., et al.: Metagenomics and personalized medicine., Cell, 147, 44-56 (Sep. 2011).
Wang, D., et al., Viral discovery and sequence recovery using DNA microarrays., PLoS Biol. 1(2), E2, 257-260 (2003).
Wang, Y., et al., Detection of viral agents in fecal specimens of monkeys with diarrhea. J. Med. Primatol. 36, 101-107 (2007).
Wei, C., et al. Recovery of infectious virus by transfection of in vitro-generated RNA from tulane calicivirus cDNA., J. Virol., 82(22), 11429-11436 (Nov. 2008).
Wommack, K.E., et al., Metagenomics: read length matters., Appl. Envir. Microbiol., 74(5), 1453-1463 (Mar. 2008).
Yatsuneko, T., et al., Human gut microbiome viewed across age and geography., Nature, 486, 222-227 (Jun. 2012).
Zhao, G., et al., The genome of Yoka poxvirus., J. Virol., 85(19), 10230-10238 (Oct. 2011).

\* cited by examiner

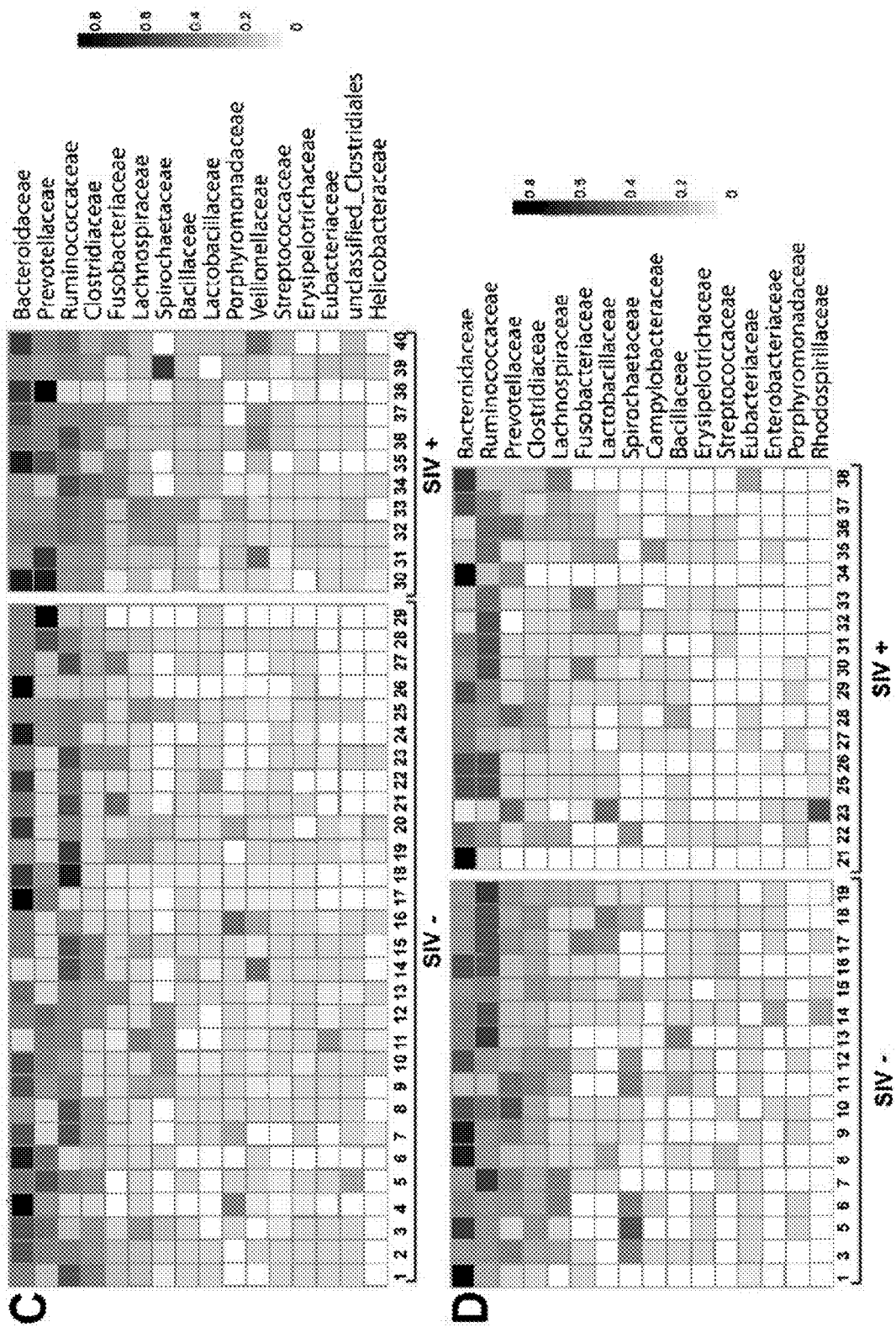

VIRUSES ASSOCIATED WITH IMMUNODEFICIENCY AND ENTEROPATHY AND METHODS USING SAME

STATEMENT OF GOVERNMENT SUPPORT

This invention was made with government support under AI057160 and OD011170 awarded by the National Institutes of Health. The government has certain rights in the invention.

BACKGROUND OF THE INVENTION

Human immunodeficiency virus (HIV) infection of humans and pathogenic simian immunodeficiency virus (SIV) infection of rhesus monkeys causes progressive immunocompromise and acquired immune deficiency syndrome (AIDS). One hallmark that correlates with the rate of progression to AIDS is systemic immune activation. Systemic immune activation is, in turn, associated with damage to the intestinal epithelium (enteropathy) and translocation of as-yet-undefined immunostimulatory pathogen-associated molecular patterns (PAMPS) or antigens into tissues and the blood.

Despite the importance of intestinal barrier damage to AIDS progression, the mechanisms responsible for AIDS enteropathy are not understood. One possibility is that immunodeficiency leads to epithelial damage by intestinal viruses or other pathogens. The mammalian virome and bacterial microbiome is extremely complex and can contribute to immune status and disease in a range of settings. Thus far, a prior study that utilized 16S rDNA sequencing, which was unable to detect viruses, found no discernible differences in the diversity of bacteria associated with SIV infection (McKenna et al., PLoS Pathog. 4: e20 (2008)). However, it remained a possibility that the virome, a subset of the metagenome that may be defined as viruses that infect eukaryotic cells, contributes to epithelial damage during lentiviral infection.

It is therefore important to understand the contribution of the virome to lentiviral infection-associated phenotypes, such as enteropathy. There is an unmet need in the field for understanding the contribution of the virome upon lentiviral infection, as well as for the development of alternative methods of diagnosing and treating lentiviral infections (e.g., HIV).

SUMMARY OF THE INVENTION

This invention relates to the discovery of previously undescribed viruses that are associated with significant expansion of the virome during lentiviral infection. In a first aspect, the invention features isolated polynucleotides including all or a portion of a nucleotide sequence that is at least 70% identical (e.g., at least 71%, 72%, 73%, or 74% identical), at least 75% identical (e.g., at least 76%, 77%, 78%, or 79% identical), at least 80% identical (e.g., at least 81%, 82%, 83%, or 84% identical), at least 85% identical (e.g., at least 86%, 87%, 88%, or 89% identical), at least 90% identical (e.g., at least 91%, 92%, 93%, or 94% identical), at least 95% identical (e.g., at least 96%, 97%, 98%, or 99% identical), or 100% identical to any one of SEQ ID NOs: 1-107, or a reverse complement thereof. In some embodiments, the isolated polynucleotides include a label (e.g., a fluorophore, a hapten, an enzyme, or a radioisotope). The isolated polynucleotides of the invention may include at least 5, 6, 7, 8, 9, 10, 20, 30, 40, 50, 60, 70, 80, 90, 100, 200, 300, 400, 500, 600, 700, 800, 900, 1000, 2000, 3000, 4000, 5000, 6000, 7000 or more contiguous or non-contiguous nucleotides of a reference polynucleotide molecule. In some embodiments, the polynucleotides of the invention are between 10-100 nucleotides in length, more particularly between 10-30 nucleotides in length (e.g., 10, 11, 12, 13, 14, 15, 16, 17, 18, 19, 20, 21, 22, 23, 24, 25, 26, 27, 28, 29, or 30 nucleotides in length), and can be at least 70% identical (e.g., at least 71%, 72%, 73%, or 74% identical), at least 75% identical (e.g., at least 76%, 77%, 78%, or 79% identical), at least 80% identical (e.g., at least 81%, 82%, 83%, or 84% identical), at least 85% identical (e.g., at least 86%, 87%, 88%, or 89% identical), at least 90% identical (e.g., at least 91%, 92%, 93%, or 94% identical), at least 95% identical (e.g., at least 96%, 97%, 98%, or 99% identical), or 100% identical to any one of SEQ ID NOs: 332-371.

In another aspect, the invention features isolated polypeptides including all or a portion of an amino acid sequence that is at least 70% identical (e.g., at least 71%, 72%, 73%, or 74% identical), at least 75% identical (e.g., at least 76%, 77%, 78%, or 79% identical), at least 80% identical (e.g., at least 81%, 82%, 83%, or 84% identical), at least 85% identical (e.g., at least 86%, 87%, 88%, or 89% identical), at least 90% identical (e.g., at least 91%, 92%, 93%, or 94% identical), at least 95% identical (e.g., at least 96%, 97%, 98%, or 99% identical), or 100% identical to any one of SEQ ID NOs: 108-331. In some embodiments, the isolated polypeptides include a label (e.g., a fluorophore, a hapten, an enzyme, or a radioisotope). The isolated polypeptides of the invention may include at least 5, 6, 7, 8, 9, 10, 11, 12, 13, 14, 15, 16, 17, 18, 19, 20, 25, 50, 75, 90, 100, 125, 150, 175, 200, 225, 250, 275, 300, or 350 or more contiguous or non-contiguous amino acids of a reference polypeptide molecule.

In another aspect, the invention features isolated antibodies, or fragments thereof, that are specific for one or more of the isolated polynucleotides or polypeptides of the invention. In some embodiments, the isolated antibodies, or fragments thereof, may be chimeric, human, humanized, or synthetic. In other embodiments, the isolated antibodies, or fragments thereof, may further include a label.

In another aspect, the invention features recombinant expression systems for the production of a protein, or fragment thereof, that is encoded by the polynucleotides of the invention. In some embodiments, the recombinant expression system is an in vitro or an in vivo expression system. In other embodiments, the recombinant expression system further includes a cell (e.g., a bacterial, plant, or mammalian cell). In yet other embodiments, the mammalian cell is a Chinese hamster ovary (CHO) cell.

In another aspect, the invention features recombinant viruses including one or more of the isolated polynucleotides and/or one or more of the isolated polypeptides of the invention. In one preferred embodiment, the viruses further include a genome including a heterologous nucleic acid encoding an antigenic gene product of interest or fragment thereof, or the viruses further include a capsid including a heterologous antigenic gene product of interest or fragment thereof. In another preferred embodiment, the antigenic gene product, or fragment thereof, includes a bacterial, viral, parasitic, or fungal gene product, or fragment thereof. In some embodiments, all or a portion of the recombinant virus is from the viral family Adenoviridae, Parvoviridae, Caliciviridae, Papillomaviridae, Picobirnaviridae, Picornaviridae, or Polyomaviridae. In preferred embodiments, the viral family is Adenoviridae or Parvoviridae.

In another aspect, the invention features methods of detecting acquired immune deficiency syndrome (AIDS) and/or AIDS progression in a subject including detecting one or more target nucleotide sequences from a sample of the subject that specifically hybridize under stringent conditions to one or more of the polynucleotides of the invention, where the detection of an increase in the level of the one or more target nucleotide sequences in the subject, relative to the level of one or more target nucleotide sequences from a control subject, indicates AIDS and/or AIDS progression in the subject.

In another aspect, the invention features methods of diagnosing, or providing a prognostic indicator of, immunodeficiency and/or enteropathy in a subject including detecting one or more target nucleotide sequences from a sample of the subject that specifically hybridize under stringent conditions to one or more of the polynucleotides of the invention, where the detection of an increase in the level of the one or more target nucleotide sequences in the subject, relative to the level of one or more target nucleotide sequences from a control subject, indicates the presence of, or the propensity to develop, immunodeficiency and/or enteropathy in the subject. In some embodiments, the immunodeficiency and/or enteropathy is associated with a lentivirus (e.g., human immunodeficiency virus (HIV) or simian immunodeficiency virus (SIV)).

In yet another aspect, the invention features methods of identifying a therapeutic agent for use in treating immunodeficiency and/or enteropathy in a subject including detecting one or more target nucleotide sequences that specifically hybridize under stringent conditions to one or more of the polynucleotides of the invention from a sample of a subject administered a therapeutically effective amount of a candidate agent, where the detection of a decrease in the level of the one or more target nucleotide sequences in the subject, relative to the level of one or more target nucleotide sequences from the subject prior to administration or a control subject, identifies the candidate agent as the therapeutic agent. In some embodiments, the candidate agent is administered to the subject in a therapeutically effective amount. In other embodiments, the immunodeficiency and/or enteropathy is associated with a lentivirus (e.g., human immunodeficiency virus (HIV) or simian immunodeficiency virus (SIV)).

In other aspects, the invention features nucleic acid-based vaccines including a vector including the polynucleotides of the invention as well as isolated recombinant cells including the polynucleotides of the invention (e.g., all or a portion of a polynucleotide having at least 70%, 80%, 85%, 90%, 95%, 99%, or 100% sequence identity to any one or more of SEQ ID NOs: 1-107 and/or 332-371, or a reverse complement thereof).

In other aspects, the invention features polypeptide-based vaccines including the polypeptides of the invention (e.g., all or a portion of a polypeptide having at least 70%, 80%, 85%, 90%, 95%, 99%, or 100% sequence identity to any one or more of SEQ ID NOs: 108-331).

In any of the methods described herein, the detecting of one or more target nucleotide sequences may include synthesizing cDNA from RNA of the sample.

In any of the embodiments described herein, the one or more target nucleotide sequences are detected by a PCR assay (e.g., a real time PCR (RT-PCR) assay and/or a nested PCR assay).

In any of the embodiments described herein, the sample is a tissue, organ, liquid, or feces sample. In preferred embodiments, the sample is from a mammal, preferably a primate, such as a human.

DEFINITIONS

The term "antibody" is used in the broadest sense and includes monoclonal antibodies (e.g., full-length or intact monoclonal antibodies), polyclonal antibodies, multivalent antibodies, multispecific antibodies (e.g., bispecific antibodies so long as they exhibit the desired biological activity) and may also include certain antibody fragments (as described in greater detail herein). An antibody typically comprises both "light chains" and "heavy chains." The light chains of antibodies (immunoglobulins) from any vertebrate species can be assigned to one of two clearly distinct types, called kappa (κ) and lambda (λ), based on the amino acid sequences of their constant domains. Depending on the amino acid sequence of the constant domain of their heavy chains, immunoglobulins can be assigned to different classes. There are five major classes of immunoglobulins: IgA, IgD, IgE, IgG, and IgM, and several of these can be further divided into subclasses (isotypes), e.g., IgG1, IgG2, IgG3, IgG4, IgA1, and IgA2. The heavy chain constant domains that correspond to the different classes of immunoglobulins are called α, δ, ε, γ, and μ, respectively. The subunit structures and three-dimensional configurations of different classes of immunoglobulins are well known.

"Antibody fragments" of "fragments" comprise only a portion of an intact antibody, wherein the portion preferably retains at least one, preferably most or all, of the functions normally associated with that portion when present in an intact antibody. Examples of antibody fragments include Fab, Fab', F(ab')$_2$, and Fv fragments (e.g., single-chain variable fragments (scFv)); diabodies; linear antibodies; single-chain antibody molecules; and multispecific antibodies formed from antibody fragments. Papain digestion of antibodies produces two identical antigen-binding fragments, called "Fab" fragments, each with a single antigen-binding site, and a residual "Fc" fragment, whose name reflects its ability to crystallize readily. Pepsin treatment yields an F(ab')$_2$ fragment that has two antigen-combining sites and is still capable of cross-linking antigen. In one embodiment, an antibody fragment comprises an antigen binding site of the intact antibody and thus retains the ability to bind antigen. In another embodiment, an antibody fragment, for example one that comprises the Fc region, retains at least one of the biological functions normally associated with the Fc region when present in an intact antibody, such as FcRn binding, antibody half life modulation, ADCC function, ADCVI function, and complement binding. In one embodiment, an antibody fragment is a monovalent antibody that has an in vivo half life substantially similar to an intact antibody. For example, such an antibody fragment may comprise on antigen binding arm linked to an Fc sequence capable of conferring in vivo stability to the fragment.

By "capsid" is meant a protein shell or coat of a virus which often adopts a helical or icosahedral structure. The capsid of an adenovirus, for example, adopts an icosahedral structure and consists of three major structural proteins: hexon, penton, and fiber proteins. The capsid encloses the genetic material of the virus.

Throughout this specification and claims, the word "comprise," or variations such as "comprises" or "comprising,"

will be understood to imply the inclusion of a stated integer or group of integers but not the exclusion of any other integer or group of integers.

By "enteropathy" is meant damage to the intestinal epithelium, commonly associated with lentiviral infection (e.g., human immunodeficiency virus (HIV) infection in humans), which can result in intestinal leakage associated with increased serum LPS binding protein (LBP) levels and systemic immune activation. Enteritis, inflammation of the intestinal epithelium, is a type of enteropathy.

By "gene product" is meant to include mRNAs or other nucleic acids (e.g., microRNAs) transcribed from a gene as well as polypeptides translated from those mRNAs.

By "heterologous nucleic acid molecule" is meant any exogenous nucleic acid molecule that can be incorporated into, for example, a virus or expression system of the invention for subsequent expression of a gene product of interest or fragment thereof encoded by the heterologous nucleic acid molecule. In a preferred embodiment, the heterologous nucleic acid molecule encodes an antigenic gene that is of bacterial, viral, parasitic, or fungal origin (e.g., a nucleic acid molecule encoding the HIV Gag, Pol, Env, Nef, Tat, Rev, Vif, Vpr, or Vpu gene product, or fragment thereof). The heterologous nucleic acid molecule is one that is not normally associated with the other nucleic acid molecules found in virus or expression system.

By "immunodeficiency" is meant a compromised immune system of a subject relative to that of a control, whereby the compromise of the immune system can be measured by a decrease in the levels of CD4 T cells, B cells, plasma cells, antibodies, or neutrophil granulocytes of the subject relative to that of the control.

By "isolated" is meant separated, recovered, or purified from a component of its natural environment.

A "label" refers to a molecular moiety or compound that is detected or leads to a detectable signal. A label may be joined directly or indirectly to a polynucleotide, polypeptide, or a probe thereof. Direct labeling can occur through bonds or interactions that link the label to the probe, including covalent bonds or non-covalent interactions, e.g. hydrogen bonds, hydrophobic and ionic interactions, or formation of chelates or coordination complexes. Indirect labeling can occur through use of a bridging moiety or linker (e.g., antibody or additional oligomer), which is either directly or indirectly labeled, and which may amplify the detectable signal. Labels include any detectable moiety, such as a fluorophore, hapten, enzyme, radioisotope, enzyme substrate, reactive group, chromophore (e.g., a dye, a particle, or a bead that imparts detectable color), or luminescent compound (e.g., bioluminescent, phosphorescent, or chemiluminescent labels). A "radioisotope" can be any radioisotope known to skilled artisans, such as, $^3$H, $^{14}$C, $^{32}$P, $^{33}$P, $^{35}$S, or $^{125}$I. A "fluorophore" can be any fluorophore known to skilled artisan, for example, a fluorescein, a rhodamine, a coumarin, an indocyanine, or a green fluorescent protein (GFP) or variant thereof (e.g., a red fluorescent protein (RFP)). An enzyme can be any enzyme for which a suitable substrate is available, such as, for example, alkaline phosphatase, a horseradish peroxidase, or a chloramphenicol acetyltransferase. A suitable substrate is a substrate that, when contacted by an enzyme, produces a product that is detectable by methods known to skilled artisans. For example, the substrate can be a chromogenic substrate (e.g., p-dinitrophenyl phosphate as a substrate for alkaline phosphatase or diaminobenzidine as a substrate for horseradish peroxidase), a fluorogenic substrate (e.g., 5-amino-2,3-dihydrophthalazine-1,4-dione (luminol) for horseradish peroxidase or disodium 3-(4-methoxyspiro{1,2-dioxetane-3,2'-(5'chloro)tricycle[3.3.1.13,7]decan}-4-yl)phenyl phosphate for alkaline phosphatase). A "hapten" can be any hapten for which a probe is available, such as biotin, streptavidin, or digoxigenin.

By "portion" is meant a part of a whole. A portion may comprise at least 10%, 20%, 30%, 40%, 50%, 60%, 70%, 80%, 90%, or 95% of the entire length of an polynucleotide or polypeptide sequence region. For polynucleotides, for example, a portion may include at least 5, 6, 7, 8, 9, 10, 20, 30, 40, 50, 60, 70, 80, 90, 100, 200, 300, 400, 500, 600, 700, 800, 900, 1000, 2000, 3000, 4000, 5000, 6000, 7000 or more contiguous nucleotides of a reference polynucleotide molecule. For polypeptides, for example, a portion may include at least 5, 6, 7, 8, 9, 10, 11, 12, 13, 14, 15, 16, 17, 18, 19, 20, 25, 50, 75, 90, 100, 125, 150, 175, 200, 225, 250, 275, 300, or 350 or more contiguous amino acids of a reference polypeptide molecule.

By "recombinant," with respect to an expression system or virus, is meant an expression system or virus that has been manipulated in vitro. For example, an expression system or virus which includes a heterologous nucleic acid sequence, such as a sequence encoding an antigenic gene product, introduced using recombinant nucleic acid techniques.

By "sample" is meant any biological substance obtained from a subject, such as a biological feces (stool), fluid, tissue, or organ sample. A biological fluid sample can be, without limitation, a blood sample, a plasma sample, a serum sample, a cerebrospinal fluid sample, a urine sample, or a saliva sample.

By "sequence identity" or "sequence similarity" is meant that the identity or similarity between two or more amino acid sequences, or two or more nucleotide sequences, is expressed in terms of the identity or similarity between the sequences. Sequence identity can be measured in terms of "percentage (%) identity," wherein the higher the percentage, the more identity shared between the sequences. Sequence similarity can be measured in terms of percentage similarity (which takes into account conservative amino acid substitutions); the higher the percentage, the more similarity shared between the sequences. Homologs or orthologs of nucleic acid or amino acid sequences possess a relatively high degree of sequence identity similarity when aligned using standard methods. Sequence identity may be measured using sequence analysis software on the default setting (e.g., Sequence Analysis Software Package of the Genetics Computer Group, University of Wisconsin Biotechnology Center, 1710 University Avenue, Madison, Wis. 53705). Such software may match similar sequences by assigning degrees of homology to various substitutions, deletions, and other modifications.

By "specifically hybridizes" is meant hybridization, under stringent hybridization conditions, of a first polynucleotide (e.g., a probe or primer) to a second polynucleotide (e.g., a target sequence) to a detectably greater degree than hybridization of the first polynucleotide to non-target polynucleotide sequences and/or to the substantial exclusion of non-target polynucleotide sequences. Selectively hybridizing sequences have at least 70% sequence identity, at least 80% sequence identity, at least 90% sequence identity, or 100% sequence identity (e.g., complementary) with each other.

The term "stringent conditions" refers to conditions under which a probe will hybridize to its target sequence to a detectably greater degree than to other sequences. Stringent conditions are sequence-dependent and will be different in different circumstances. Longer sequences hybridize specifically at higher temperatures. Generally, stringent conditions are selected to be about 5° C. lower than the thermal melting point ($T_m$) for the specific sequence at a defined ionic strength and pH. The $T_m$ is the temperature (under defined ionic strength and pH) at which 50% of a complementary target sequence hybridizes to a perfectly matched probe. Typically, stringent conditions will be those in which the salt concentration is less than about 1.0 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents, such as formamide.

A "subject" is a vertebrate, such as a mammal (e.g., primates and humans). Mammals also include, but are not limited to, farm animals (such as cows), sport animals, pets (such as cats, dogs, and horses), mice, and rats.

By "therapeutically effective amount" is meant an amount of a therapeutic agent that alone, or together with one or more additional (optional) therapeutic agents, produces beneficial or desired results upon administration to a mammal. The therapeutically effective amount depends upon the context in which the therapeutic agent is applied. For example, in the context of administering a composition including a therapeutic agent, the therapeutically effective amount of the composition is an amount sufficient to achieve a reduction in the level of an infectious virus, such as HIV or SIV (e.g., as measured by a stabilization or an increase in CD4 T cell count relative to a control), and/or a reduction in the level of enteropathy (e.g., as measured by a decrease in serum LBP levels relative to a control) as compared to a response obtained without administration of the composition, and/or to prevent the propagation of an infectious virus (e.g., HIV) in a subject (e.g., a human) having an increased risk of viral infection. Ideally, a therapeutically effective amount provides a therapeutic effect without causing a substantial cytotoxic effect in the subject. In general, a therapeutically effective amount of a composition administered to a subject (e.g., a human subject) will vary depending upon a number of factors associated with that subject, for example the overall health of the subject, the condition to be treated, or the severity of the condition. A therapeutically effective amount of a composition can be determined by varying the dosage of the product and measuring the resulting therapeutic response.

As used herein, and as well understood in the art, "treatment" is an approach for obtaining beneficial or desired results, such as clinical results. Beneficial or desired results can include, but are not limited to, alleviation or amelioration of one or more symptoms or conditions; diminishment of extent of disease, disorder, or condition; stabilization (i.e., not worsening) of a state of disease, disorder, or condition; prevention of spread of disease, disorder, or condition; delay or slowing the progress of the disease, disorder, or condition; amelioration or palliation of the disease, disorder, or condition; and remission (whether partial or total), whether detectable or undetectable. "Palliating" a disease, disorder, or condition means that the extent and/or undesirable clinical manifestations of the disease, disorder, or condition are lessened and/or time course of the progression is slowed or lengthened, as compared to the extent or time course in the absence of treatment.

Other features and advantages of the invention will be apparent from the following Detailed Description, the drawings, and the claims.

BRIEF DESCRIPTION OF THE DRAWINGS

FIG. 9C). Samples for 16S rDNA sequencing were obtained over a period of months in 1996, while samples for this study were obtained in 2011. Circles indicate 16S rDNA sequencing data from McKenna et al.; squares indicate sequencing data from this study.

FIG. 9C). Samples for 16S rDNA sequencing were obtained over a period of months in 1996, while samples for this study were obtained in 2011. Circles indicate 16S rDNA sequencing data from McKenna et al.; squares indicate sequencing data from this study.

FIG. 9C is a heatmap displaying the number of sequences assigned to specific bacterial families for each individual pathogenic SIV-infected and control rhesus monkeys housed at the TNPRC. The nature of SIV infection is as defined for FIG. 1C.

FIG. 9D is a heatmap displaying the number of sequences assigned to specific bacterial families for each individual nonpathogenic SIV-infected and control vervet African green monkeys housed at the NIH. The nature of SIV infection is as defined for FIG. 1D.

DETAILED DESCRIPTION

Figures 1A, 1B:
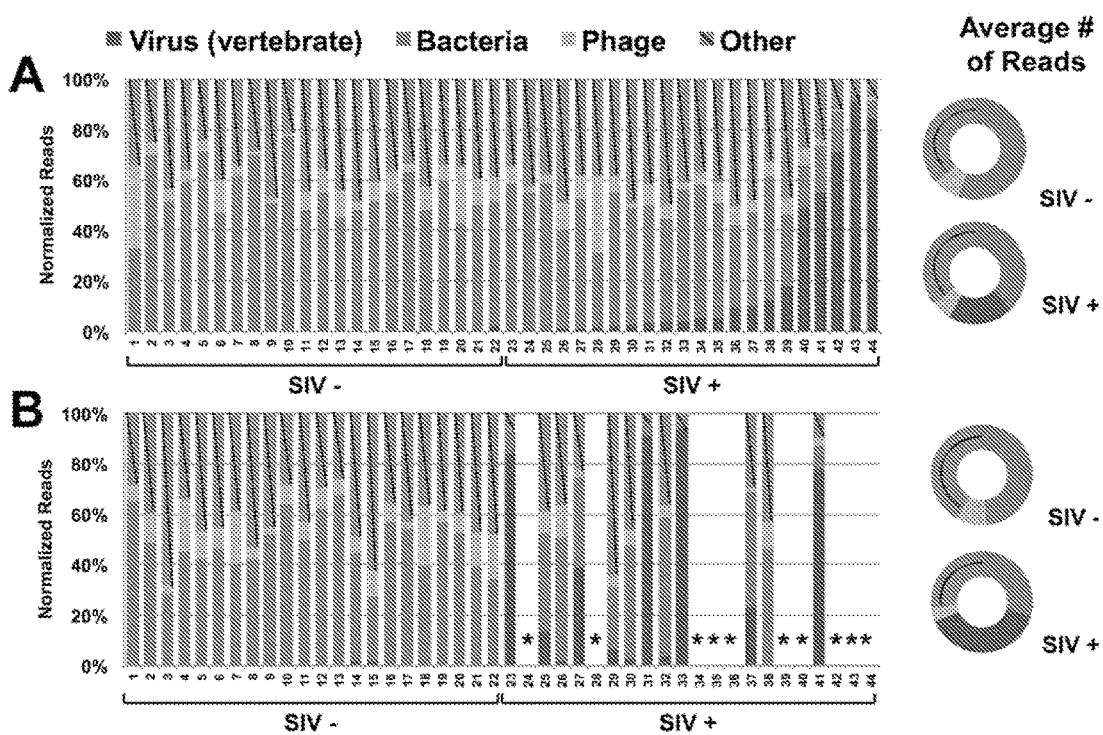
FIG. 1A is a graph showing the taxonomic distribution of sequences identified in feces of pathogenic SIV-infected (SIV+) and uninfected (SIV−) control rhesus monkeys housed at the NEPRC 24 weeks after intrarectal infection with SIVmac251. The flanking doughnut chart displays the averaged values per kingdom for SIV+ or SIV− monkeys.
FIG. 1B is a graph showing the taxonomic distribution of sequences identified in feces of pathogenic SIV-infected (SIV+) and uninfected (SIV−) control rhesus monkeys described in FIG. 1A housed at the NEPRC 64 weeks after SIV infection. * indicates euthanized for progressive AIDS 24 to 64 weeks after SIV infection. The flanking doughnut chart displays the averaged values per kingdom for SIV+ or SIV− monkeys.

The present invention relates to the discovery that pathogenic SIV infection is associated with a significant and unexpected expansion of the enteric virome, as detected using next generation sequencing (NGS) of RNA plus DNA. We documented a remarkable number of differences in the fecal virome between pathogenically SIV-infected monkeys, uninfected control monkeys, and monkeys infected with non-pathogenic SIV. These findings included increases in viral sequences, the presence of novel viruses, the association of unsuspected adenovirus infection with intestinal disease and enteric epithelial pathology, and viremia with enteric parvoviruses in advanced AIDS. At least 32 new viruses were detected from genera that cause diseases in mammalian hosts including adenoviruses, caliciviruses, parvoviruses, picornaviruses, and polyomaviruses (see, for example, Table 3 or FIG. 5 for a summary of the identified viruses). Our assignment of viral sequences to new viruses was conservative, and thus additional sequencing may detect additional viruses in the enteric virome in SIV-infected animals.

Application of standard diagnostic approaches, such as PCR or culture, would not have identified the breadth of divergent viruses detected here, and therefore would have underestimated both the potential causes of enteritis or systemic viral infection and the diversity of antigens which might contribute to enteropathy and immune activation. Our findings show that the nature of the enteric virome can be used as a prognostic indicator of HIV progression. The nature of the enteric virome may also contribute to AIDS pathogenenesis by damaging the intestinal epithelium to allow access of microbes, PAMPs, and viral antigens into tissues and the circulation to activate the immune system and stimulate lentivirus replication.

These data challenge the notion that abnormalities in the intestinal tract in pathogenic SIV-infected primates are due to direct effects of SIV or indirect effects of SIV on immune responses to enteric bacteria (Sandler et al., *J. Infect. Dis.* 203: 780-790 (2011)). Instead, immunocompromise during lentivirus infection appears to be associated with significant expansion of the enteric virome, which results in damage to the intestine, as shown for adenoviruses in the present study. Such damage could provide access for bacterial PAMPs, or as shown here enteric viruses, into tissues and the circulation. It is already recognized that bacterial and viral contributions to intestinal pathology are not independent of each other. Clear synergies between the virome, bacteria, and host genes have been documented in murine systems (Bloom et al., *Cell Host Microbe* 9: 390-403 (2011); Cadwell et al., *Cell* 141: 1135-1145 (2010); Virgin et al., *Cell* 147: 44-56 (2011)). Importantly, it is not clear how bacterial PAMPs would explain the T cell activation characteristic of the systemic immune activation associated with AIDS progression. Our data suggest that T and B cell activation might be due to immune responses to unexpected viral antigens, as for example the parvovirus we detected in the circulation of a subset of animals. Unsuspected viral infections might also contribute to the high levels of IFN-α noted in the circulation of untreated AIDS patients. Searching for virus-specific T cell responses requires knowledge of the sequence of the viral proteins present, indicating the importance of sequencing the virome to define potential antigens that might drive immune activation in lentivirus-infected hosts.

Polynucleotides of the Invention

As a first aspect, the invention provides polynucleotide sequences related to previously undiscovered viruses of the enteric virome. The isolated polynucleotides may include all or a portion of a nucleotide sequence that is at least 70% identical (e.g., at least 71%, 72%, 73%, or 74% identical), at least 75% identical (e.g., at least 76%, 77%, 78%, or 79% identical), at least 80% identical (e.g., at least 81%, 82%, 83%, or 84% identical), at least 85% identical (e.g., at least 86%, 87%, 88%, or 89% identical), at least 90% identical (e.g., at least 91%, 92%, 93%, or 94% identical), at least 95% identical (e.g., at least 96%, 97%, 98%, or 99% identical), or 100% identical to any one of SEQ ID NOs: 1-107, or a reverse complement thereof. In some embodiments, the isolated polynucleotides include a label (e.g., a fluorophore, a hapten, an enzyme, or a radioisotope). The isolated polynucleotides of the invention may include at least 5, 6, 7, 8, 9, 10, 20, 30, 40, 50, 60, 70, 80, 90, 100, 200, 300, 400, 500, 600, 700, 800, 900, 1000, 2000, 3000, 4000, 5000, 6000, 7000 or more contiguous or non-contiguous nucleotides of a reference polynucleotide molecule. In some embodiments, the polynucleotides of the invention are between 10-100 nucleotides in length, more particularly between 10-30 nucleotides in length (e.g., 10, 11, 12, 13, 14, 15, 16, 17, 18, 19, 20, 21, 22, 23, 24, 25, 26, 27, 28, 29, or 30 nucleotides in length), and can be at least 70% identical (e.g., at least 71%, 72%, 73%, or 74% identical), at least 75% identical (e.g., at least 76%, 77%, 78%, or 79% identical), at least 80% identical (e.g., at least 81%, 82%, 83%, or 84% identical), at least 85% identical (e.g., at least 86%, 87%, 88%, or 89% identical), at least 90% identical (e.g., at least 91%, 92%, 93%, or 94% identical), at least 95% identical (e.g., at least 96%, 97%, 98%, or 99% identical), or 100% identical to any one of SEQ ID NOs: 332-371. SEQ ID NOs: 332-371 (see, for example, Table 1) disclose primers that can be utilized in a PCR assay to screen for the presence of the viruses.

Polypeptides of the Invention

In another aspect, the invention features isolated polypeptides including all or a portion of an amino acid sequence that is at least 70% identical (e.g., at least 71%, 72%, 73%, or 74% identical), at least 75% identical (e.g., at least 76%, 77%, 78%, or 79% identical), at least 80% identical (e.g., at least 81%, 82%, 83%, or 84% identical), at least 85% identical (e.g., at least 86%, 87%, 88%, or 89% identical), at least 90% identical (e.g., at least 91%, 92%, 93%, or 94% identical), at least 95% identical (e.g., at least 96%, 97%, 98%, or 99% identical), or 100% identical to any one of SEQ ID NOs: 108-331. In some embodiments, the isolated polypeptides include a label (e.g., a fluorophore, a hapten, an enzyme, or a radioisotope). The isolated polypeptides of the invention may include at least 5, 6, 7, 8, 9, 10, 11, 12, 13, 14, 15, 16, 17, 18, 19, 20, 25, 50, 75, 90, 100, 125, 150, 175, 200, 225, 250, 275, 300, or 350 or more contiguous or non-contiguous amino acids of a reference polypeptide molecule.

Antibodies, Recombinant Expression Systems, and Viruses of the Invention

The invention features isolated antibodies, or fragments thereof, that are specific for one or more of the isolated polynucleotides or polypeptides of the invention. The isolated antibodies, or fragments thereof, may be chimeric, human, humanized, or synthetic, and may further include a label.

In another aspect, the invention features recombinant expression systems for the production of a protein, or fragment thereof, that is encoded by the polynucleotides of the invention. The recombinant expression system may be an in vitro or an in vivo expression system and may further include a cell. The cell may be a bacterial cell (e.g., an *E coli* cell), a plant cell, or a mammalian cell (e.g., a Chinese hamster ovary (CHO) cell).

In yet another aspect, the invention features recombinant viruses including one or more of the isolated polynucleotides and/or one or more of the isolated polypeptides of the invention. In one preferred embodiment, the viruses further include a genome including a heterologous nucleic acid encoding an antigenic gene product of interest or fragment thereof, or the viruses further include a capsid including a heterologous antigenic gene product of interest or fragment thereof. The antigenic gene product, or fragment thereof, may include a bacterial, viral, parasitic, or fungal gene product, or fragment thereof. Non-limiting examples of bacterial gene products, or fragments thereof, include 10.4, 85A, 85B, 86C, CFP-10, Rv3871, and ESAT-6 gene products, or fragments thereof, of *Mycobacterium*; O, H, and K antigens, or fragments thereof, of *E. coli*; and protective antigen (PA), or fragments thereof, of *Bacillus anthracis*. Non-limiting examples of viral gene products, or fragments thereof, include Gag, Pol, Nef, Tat, Rev, Vif, Vpr, or Vpu, or fragments thereof, of HIV and other retroviruses; 9D antigen, or fragments thereof, of HSV; Env, or fragments thereof, of all envelope protein-containing viruses. Non-limiting examples of parasitic gene products, or fragments thereof, include circumsporozoite (CS) protein, gamete surface proteins Pfs230 and Pfs4845, and Liver Specific Antigens 1 or 3 (LSA-1 or LSA-3), or fragments thereof, of *Plasmodium falciparum*. Non-limiting examples of fungal gene products, or fragments thereof, include any cell wall mannoprotein (e.g., Afmp1 of *Aspergillus fumigatus*) or surface-expressed glycoprotein (e.g., SOWgp of *Coccidioides immitis*). In some embodiments, all or a portion of the recombinant virus is from the viral family Adenoviridae, Parvoviridae, Caliviridae, Papillomaviridae, Picobirnaviridae, Picornaviridae, or Polyomaviridae. In preferred embodiments, the viral family is Adenoviridae or Parvoviridae. For example, in some embodiments, all or a portion of the recombinant virus of the invention may be from WUHARV Adenovirus 1 and have all or a portion of a nucleotide sequence that is at least 70% identical to any one of SEQ ID NOs: 1-13 and/or express all or a portion of a polypeptide sequence that is at least 70% identical to any one of SEQ ID NOs: 108-163. In some embodiments, the recombinant virus of the invention may be from WUHARV Adenovirus 2 or 3 and have all or a portion of a nucleotide sequence that is at least 70% identical to any one of SEQ ID NOs: 14-54 and/or express all or a portion of a polypeptide sequence that is at least 70% identical to any one of SEQ ID NOs: 164-256. In some embodiments, the recombinant virus of the invention may be from WUHARV Adenovirus 4 and have all or a portion of a nucleotide sequence that is at least 70% identical to SEQ ID NO: 55 or SEQ ID NO: 56 and/or express all or a portion of a polypeptide sequence that is at least 70% identical to SEQ ID NO: 257 or SEQ ID NO: 258. In some embodiments, the recombinant virus of the invention may be from WUHARV Adenovirus 5 and have all or a portion of a nucleotide sequence that is at least 70% identical to any one of SEQ ID NOs: 57-69 and/or express all or a portion of a polypeptide sequence that is at least 70% identical to any one of SEQ ID NOs: 259-277.

Detection of Acquired Immune Deficiency Syndrome (AIDS) or AIDS Progression

Discovery of the expansion of the enteric virome in nonhuman primates infected with pathogenic SIV, but not with non-pathogenic SIV, has profound implications for understanding AIDS pathogenesis in these animals and suggests a similar expansion of the enteric virome in human AIDS. Our data are consistent with a model in which immunosuppression results in increased levels of enteric viral infection which, in a feed-forward manner, contributes to AIDS via damage to the intestinal mucosa and induction of systemic immune activation that accelerates AIDS progression. This study shows the pathogenetic potential of the enteric virome, as exemplified by animals with enteritis associated with adenovirus infection or parvovirus viremia. By sequencing both RNA and DNA and by using metagenomic approaches, rather than focusing on bacterial 16S rDNA analysis, we have documented a new set of viruses associated with clinical AIDS progression in rhesus monkeys. Since these viruses include many potential pathogens, studies of HIV and SIV pathogenesis should take them into account as possible contributors to disease progression. This provides substantial opportunity to explain and eventually intervene in the processes that lead to AIDS clinical disease progression. Our data indicate that the expansion of the enteric virome can be used as a marker for rapidly progressive disease.

Accordingly, the present invention also relates to methods of detecting acquired immune deficiency syndrome (AIDS) and/or AIDS progression in a subject by detecting one or more target nucleotide sequences from a sample of the subject that specifically hybridize under stringent conditions to one or more of the polynucleotides of the invention, where the detection of an increase in the level of the one or more target nucleotide sequences in the subject, relative to the level of one or more target nucleotide sequences from a control subject, indicates AIDS and/or AIDS progression in the subject. Detecting of the one or more target nucleotide sequences may include synthesizing cDNA from RNA of the sample, and may utilize a PCR assay for detection, such as a real time PCR (RT-PCR) assay and/or a nested PCR assay. SEQ ID NOs: 332-371 (see, for example, Table 1) disclose primers that can be utilized in a PCR assay to screen for the presence of the viruses. The sample may be a tissue, organ, liquid, or feces sample from a mammal, preferably a primate or a human. This method of detecting AIDS and/or AIDS progression in a subject can be used alone, in conjunction, or in parallel with known method(s) of detecting AIDS and/or AIDS progression, such as by the detection of CD4 T cell levels.

Diagnosis of Immunodeficiency or Enteropathy

The compositions of the invention may be used for other diagnostic purposes. In some aspects, the invention features methods of diagnosing, or providing a prognostic indicator of, immunodeficiency and/or enteropathy in a subject including detecting one or more target nucleotide sequences from a sample of the subject that specifically hybridize under stringent conditions to one or more of the polynucleotides of the invention, where the detection of an increase in the level of the one or more target nucleotide sequences in the subject, relative to the level of one or more target nucleotide sequences from a control subject, indicates the presence of, or the propensity to develop, immunodeficiency and/or enteropathy in the subject. Detecting one or more target nucleotide sequences may include synthesizing cDNA from RNA of the sample, and may utilize a PCR assay for detection, such as a real time PCR (RT-PCR) assay and/or a nested PCR assay. SEQ ID NOs: 332-371 (see, for example, Table 1) disclose primers that can be utilized in a PCR assay to screen for the presence of the viruses. The sample may be a tissue, organ, liquid, or feces sample from a mammal, preferably a primate or a human. This method of diagnosing, or providing a prognostic indicator of, immunodeficiency and/or enteropathy in a subject can be used alone, in conjunction, or in parallel with known method(s) of diagnosing, or providing a prognostic indicator of, immunodeficiency and/or enteropathy, such as by the detection of CD4 T cell levels and/or serum LPS binding protein (LBP) levels.

Treatment of Immunodeficiency or Enteropathy

In other aspects, the compositions of the invention may be used for therapeutic purposes. For example, the invention features nucleic acid- or polypeptide-based vaccines. The vaccines may include a vector that includes the polynucleotides of the invention or a vaccine that includes a polypeptide of the invention. In addition, the invention features methods of identifying a therapeutic agent for use in treating immunodeficiency and/or enteropathy in a subject including detecting one or more target nucleotide sequences that specifically hybridize under stringent conditions to one or more of the polynucleotides of the invention from a sample of a subject administered a therapeutically effective amount of a candidate agent, where the detection of a decrease in the level of the one or more target nucleotide sequences in the subject, relative to the level of one or more target nucleotide sequences from the subject prior to administration or a control subject, identifies the candidate agent as the therapeutic agent. In some embodiments, the candidate agent is administered to the subject in a therapeutically effective amount. In other embodiments, the immunodeficiency and/or enteropathy is associated with a lentivirus (e.g., human immunodeficiency virus (HIV) or simian immunodeficiency virus (SIV)). Detecting one or more target nucleotide sequences may include synthesizing cDNA from RNA of the sample, and may utilize a PCR assay for detection, such as a real time PCR (RT-PCR) assay and/or a nested PCR assay. SEQ ID NOs: 332-371 (see, for example, Table 1) disclose primers that can be utilized in a PCR assay to screen for the presence of the viruses. The sample may be a tissue, organ, liquid, or feces sample from a mammal, preferably a primate or human.

Administration of a Therapeutic Agent

The vaccines of the invention or the therapeutic agent, once identified by the methods of the invention, can be administered to a subject (e.g., a human), pre- or post-lentiviral (e.g., HIV) infection, to treat, prevent, ameliorate, inhibit the progression of, or reduce the severity of immunocompromise and/or enteropathy. The subject, at the time of administration, may present as symptomatic or asymptomatic. In addition, the vaccine or identified therapeutic agent may also treat, prevent, ameliorate, inhibit the progression of, or reduce the severity of one or more symptoms, if present, of lentiviral (e.g., HIV) infection. Examples of the symptoms caused by lentiviral infection include one or more of, e.g., fever, muscle aches, coughing, sneezing, runny nose, sore throat, headache, chills, diarrhea, vomiting, rash, weakness, dizziness, bleeding under the skin, in internal organs, or from body orifices like the mouth, eyes, or ears, shock, nervous system malfunction, delirium, seizures, renal (kidney) failure, personality changes, neck stiffness, dehydration, seizures, lethargy, paralysis of the limbs, confusion, back pain, loss of sensation, impaired bladder and bowel function, and sleepiness that can progress into coma or death. These symptoms, and their resolution during treatment, may be measured by, e.g., a physician during a physical examination or by other tests and methods known in the art.

The vaccines or therapeutic agents can be formulated for administration alone or as a pharmaceutical composition by a route selected from, e.g., intramuscular, intravenous, intradermal, intraarterial, intraperitoneal, intralesional, intracranial, intraarticular, intraprostatical, intrapleural, intratracheal, intranasal, intravitreal, intravaginal, intrarectal, topical, intratumoral, peritoneal, subcutaneous, subconjunctival, intravesicular, mucosal, intrapericardial, intraumbilical, intraocularal, oral, or local administration, or by inhalation, by injection, by infusion, by continuous infusion, by localized perfusion bathing target cells directly, by catheter, by lavage, by gavage, in cremes, or in lipid compositions. The preferred method of administration can vary depending on various factors (e.g., the components of the composition being administered and the severity of the condition being treated). Formulations suitable for oral or nasal administration may consist of liquid solutions, such as an effective amount of the composition dissolved in a diluent (e.g., water, saline, or PEG-400), capsules, sachets, tablets, or gels, each containing a predetermined amount of the chimeric Ad5 vector composition of the invention. The pharmaceutical composition may also be an aerosol formulation for inhalation, e.g., to the bronchial passageways. Aerosol formulations may be mixed with pressurized, pharmaceutically acceptable propellants (e.g., dichlorodifluoromethane, propane, or nitrogen). In particular, administration by inhalation can be accomplished by using, e.g., an aerosol containing sorbitan trioleate or oleic acid, for example, together with trichlorofluoromethane, dichlorofluoromethane, dichlorotetrafluoroethane, or any other biologically compatible propellant gas.

Immunogenicity of the vaccine of the invention may be significantly improved if it is co-administered with an immunostimulatory agent or adjuvant. Suitable adjuvants well-known to those skilled in the art include, e.g., aluminum phosphate, aluminum hydroxide, QS21, Quil A (and derivatives and components thereof), calcium phosphate, calcium hydroxide, zinc hydroxide, glycolipid analogs, octodecyl esters of an amino acid, muramyl dipeptides, polyphosphazene, lipoproteins, ISCOM matrix, DC-Chol, DDA, cytokines, and other adjuvants and derivatives thereof.

The vaccine or therapeutic agent of the invention, or a pharmaceutical composition including the same, may be formulated to release the vaccine or therapeutic agent immediately upon administration (e.g., targeted delivery) or at any predetermined time period after administration using controlled or extended release formulations. Administration in controlled or extended release formulations is useful where the vaccine or agent, either alone or in combination, has (i) a narrow therapeutic index (e.g., the difference between the plasma concentration leading to harmful side effects or toxic reactions and the plasma concentration leading to a therapeutic effect is small; generally, the therapeutic index, TI, is defined as the ratio of median lethal dose ($LD_{50}$) to median effective dose ($ED_{50}$)); (ii) a narrow absorption window at the site of release (e.g., the gastro-intestinal tract); or (iii) a short biological half-life, so that frequent dosing during a day is required in order to sustain a therapeutic level.

Many strategies can be pursued to obtain controlled or extended release in which the rate of release outweighs the rate of metabolism of the vaccine or therapeutic agent, or the pharmaceutical composition including the same. For example, controlled release can be obtained by the appropriate selection of formulation parameters and ingredients, including, e.g., appropriate controlled release compositions and coatings. Suitable formulations are known to those of skill in the art. Examples include single or multiple unit tablet or capsule compositions, oil solutions, suspensions, emulsions, microcapsules, microspheres, nanoparticles, patches, and liposomes.

The vaccine or therapeutic agent may be administered, e.g., 1, 2, 3, 4, 5, 6, 7, 8, 9, 10, 15, 20, 30, 35, 40, 45, 50, 55, or 60 minutes, 2, 4, 6, 10, 15, or 24 hours, 2, 3, 5, or 7 days, 2, 4, 6 or 8 weeks, or even 3, 4, or 6 months pre-exposure, or may be administered to the subject 15-30 minutes or 1, 2, 3, 4, 5, 6, 7, 8, 9, 10, 12, 20, 24, 48, or 72 hours, 2, 3, 5, or 7 days, 2, 4, 6 or 8 weeks, 3, 4, 6, or 9 months, 1, 2, 3, 4, 5, 6, 7, 8, 9, 10, 15, 20 years or longer post-exposure to the infective agent, alone or in a pharmaceutical composition.

When treating disease (e.g., AIDS due to HIV infection), the vaccine or therapeutic agent may be administered to the subject either before a definitive diagnosis, before the occurrence of immunodeficiency and/or enteropathy, or after diagnosis or symptoms become evident. For example, the pharmaceutical composition including the vaccine or therapeutic agent may be administered, e.g., immediately after diagnosis or the clinical recognition of symptoms or 2, 4, 6, 10, 15, or 24 hours, 2, 3, 5, or 7 days, 2, 4, 6 or 8 weeks, or even 3, 4, or 6 months after diagnosis or detection of symptoms.

The vaccines or therapeutic agents may be sterilized by conventional sterilization techniques, or may be sterile filtered. The resulting aqueous solutions may be packaged for use as is, or lyophilized; the lyophilized preparation may be administered in powder form or combined with a sterile aqueous carrier prior to administration. The pH of the preparations typically will be between 3 and 11, more preferably between 5 and 9 or between 6 and 8, and most preferably between 7 and 8, such as 7 to 7.5. The resulting compositions in solid form may be packaged in multiple single dose units, each containing a fixed amount of the vaccine or therapeutic agent, and, if desired, one or more immunomodulatory agents, such as in a sealed package of tablets or capsules, or in a suitable dry powder inhaler (DPI) capable of administering one or more doses.

Dosages

The dose of the vaccine or therapeutic agent or the number of treatments using the same may be increased or decreased based on the severity of, occurrence of, or progression of, the level of immunocompromise and/or enteropathy in the subject (e.g., based on the severity of one or more symptoms of, e.g., viral infection). The dosage administered depends on the subject to be treated (e.g., the age, body weight, capacity of the immune system, and general health of the subject being treated), the form of administration (e.g., as a solid or liquid), the manner of administration (e.g., by injection, inhalation, dry powder propellant), and the cells targeted (e.g., epithelial cells, such as blood vessel epithelial cells, nasal epithelial cells, or pulmonary epithelial cells).

In addition, single or multiple administrations of the vaccines or therapeutic agents of the present invention may be given (pre- or post-infection) to a subject (e.g., one administration or administration two or more times). For example, subjects who are particularly susceptible to, e.g., viral infection may require multiple treatments to establish and/or maintain protection against the virus. Levels of induced immunity provided by the vaccines or therapeutic agents described herein can be monitored by, e.g., measuring CD4 T cell levels and/or serum LPS binding protein (LBP) levels. The dosages may then be adjusted or repeated as necessary to maintain desired therapeutic levels in the subject having immunocompromise and/or enteropathy associated with, e.g., a lentiviral (e.g., HIV) infection.

In some embodiments, a single dose of the vaccine or therapeutic agent may achieve protection, pre-exposure, from infective agents. In addition, a single dose administered post-exposure to a viral or other infective agent can function as a treatment according to the present invention. Multiple doses (e.g., 2, 3, 4, 5, or more doses) can also be administered, in necessary, to these subjects.

Carriers, Excipients, Diluents

The compositions of the invention may include a recombinant replication-defective Ad5 vector with chimeric hexon and fiber proteins, containing a heterologous nucleic acid molecule encoding an antigenic gene product or fragment thereof. An adenoviral vector of the invention also includes one or more of the adenoviruses identified in the present study (e.g., one or more of these adenoviruses may be used as a vector that is modified to include a heterologous nucleic acid molecule, which, upon expression in a host, produces a therapeutic immunogenic response in the host). Therapeutic formulations of the compositions of the invention are prepared using standard methods known in the art by mixing the active ingredient having the desired degree of purity with optional physiologically acceptable carriers, excipients or stabilizers (Remington's Pharmaceutical Sciences ($20^{th}$ edition), ed. A. Gennaro, 2000, Lippincott, Williams & Wilkins, Philadelphia, Pa.). Acceptable carriers, include saline, or buffers such as phosphate, citrate and other organic acids; antioxidants including ascorbic acid; low molecular weight (less than about 10 residues) polypeptides; proteins, such as serum albumin, gelatin or immunoglobulins; hydrophilic polymers such as polyvinylpyrrolidone, amino acids such as glycine, glutamine, asparagines, arginine or lysine; monosaccharides, disaccharides, and other carbohydrates including glucose, mannose, or dextrins; chelating agents such as EDTA; sugar alcohols such as mannitol or sorbitol; salt-forming counterions such as sodium; and/or nonionic surfactants such as TWEEN™, PLURONICS™, or PEG.

Optionally, the formulation contains a pharmaceutically acceptable salt, preferably sodium chloride, e.g., at about physiological concentrations. Optionally, the formulations of the invention can contain a pharmaceutically acceptable preservative. In some embodiments the preservative concentration ranges from 0.1 to 2.0%, typically vv. Suitable preservatives include those known in the pharmaceutical arts. Benzyl alcohol, phenol, m-cresol, methylparaben, and propylparaben are examples of preservatives. Optionally, the formulations of the invention can include a pharmaceutically acceptable surfactant at a concentration of 0.005 to 0.02%.

These and other aspects of the invention are further described in the Examples, below.

EXAMPLES

The following examples are to illustrate the invention. They are not meant to limit the invention in any way.

Example 1

Materials and Methods

Nucleic Acid Preparation and 454 Sequencing 100 mg or 200 mg of frozen stool was resuspended in 6 volumes of PBS (Finkbeiner et al., *PLoS Pathog.* 4: e1000011 (2008)), centrifuged to pellet particulate matter and the supernatant was then passed through a 0.45-μm filter. Total nucleic acid was isolated from 200 μL or 850 μL of this filtrate using the Ampliprep DNA extraction machine (Roche) according to manufacturer's instructions. To enable detection of both RNA and DNA viruses, 9 μL total nucleic acid from each sample was reverse transcribed and 6 μL of the cDNA reaction amplified as previously described (Wang et al., *PLoS Biol.* 1: E2 (2003)). Briefly, RNA templates were reverse transcribed using a first primer containing a 16-nucleotide specific sequence followed by 9 random nucleotides for random priming. The 16-nucleotide specific sequence was unique for each sample and served as a barcode in assigning sequencing sequences to a sample. Sequenase (United States Biochemical) was used for second strand cDNA synthesis and for random-primed amplification of DNA templates using the first primer. Each sample was subjected to 40 cycles of PCR amplification using a second primer containing the same 16 nucleotide specific sequence as in the corresponding first primer. Amplification products were quantitated, diluted to 15 ng/μL and then 5 μL of each sample was pooled, adaptor-ligated and sequenced on the 454 GS-FLX platform (454 Life Sciences).

Detection and Analysis of Viral Sequences Using Custom Bioinformatic Pipeline

Sequences were analyzed using VirusHunter as described (Presti et al., *J. Virol.* 83: 11599-11606 (2009); Loh et al., *J. Virol.* 83: 13019-13025 (2009); Zhao et al., *J. Virol.* 85: 10230-10238 (2011); Felix et al., *PLoS Biol.* 9: e1000586 (2011); Loh et al., *J. Virol.* 85: 2642-2656 (2011)). Briefly, sequences were assigned to samples based on the unique barcode sequences (i.e., the second primer sequences), primer sequences were trimmed, and sequences were clustered using CD-HIT (Li et al., *Bioinformatics* 22: 1658-1659 (2006)) to remove redundant sequences (95% identity over 95% sequence length). The longest sequence from each cluster was chosen as the representative unique sequence and entered into the analysis pipeline. Then, unique sequences were masked by RepeatMasker (Smit, et al. *RepeatMasker Open*-3.0). If a sequence did not contain a stretch of at least 50 consecutive non-"N" nucleotides or if greater than 40% of the total length of the sequence was masked, it was removed from further analysis (filtered). Filtered high quality unique non-repetitive sequences were sequentially compared against (i) the human genome using BLASTn; (ii) GenBank nt database using BLASTn; and (iii) GenBank nr database using BLASTX (Altschul et al., *J. Mol. Biol.* 215: 403-410 (1990)). Minimal e-value cutoffs of $1e^{-10}$ and $1e^{-5}$ were applied for BLASTn and BLASTX, respectively (Bench et al., *Appl. Envir. Microbiol.* 73: 7629-7641 (2007); Wommack et al., *Appl. Envir. Microbiol.* 74: 1453-1463 (2008)). Sequences were phylotyped as human, mouse, fungal, bacterial, phage, viral, or other based on the identity of the top BLAST hit. Sequences without any significant hit to any of the databases were designated as unassigned. If a sequence aligned to both a virus and another kingdom (e.g., bacteria or fungi) with the same e-value it was classified as ambiguous. All eukaryotic viral sequences were further classified into viral families based on the taxonomy ID of the best hit.

Assembly of Viral Contigs and Virus Comparison Analysis

All viral sequences, unassigned sequences, and the longest five similar sequences for those sequences from each sample were assembled into contigs using Newbler (454 Life Sciences) with default parameters. If a sample was sequenced multiple times, all available sequencing data were used to optimize contig assembly. The longest contig from amongst all contigs belonging to a given genus was chosen as the first representative contig. To compare viruses across multiple animals all sequences (contigs and sequences if no contigs were obtained from a sample) were compared with this representative virus contig. If a sequence aligned with the representative contig over its full length and shared 98% nucleotide identify or higher over the aligned region it was considered to be the same as the representative contig. For sequence that was considered as different from the representative contig, the next longest contig was selected as the second representative virus. This process was repeated until all sequences were classified. If two contigs or sequences were located at different regions of the genome, and no conclusive decision could be made about their possible relatedness, we defaulted in a conservative fashion to assuming that only a single virus was present. Representative viral contigs were queried against the NCBI nt database and the most related viral genomes were identified. The most closely related virus with full genome sequence available was selected as the reference genome. For adenoviruses different sequences shared the highest homology with different viruses, indicating that in these large genomes some regions of the new viruses we detected were most related to different viruses in the data base. Two out of the three contig sequences used for designing primers shared highest homology to simian adenovirus 1 strain ATCC VR-195, which was therefore selected as reference genome. If no nucleotide level homology was detected, viral contigs were queried for protein homology against the NCBI nr database and the most related viral genome was identified.

Metagenomic Analysis Using MEGAN

Individual sequences obtained by 454 sequencing were analyzed using BLASTX (version 2.2.22+) on a customized server with ~1700 available processor slots and a memory range of 2-32 GB per node. Sequences were compared by BLASTX to the NCBI nr database version Jun. 6, 2011. Results with an e-value $\le e^{-10}$ were stored and used for taxonomic assignment using the Lowest-Common Ancestor (LCA) algorithm in MEGAN v. 4.62.3 (22 Nov. 2011). The following LCA parameters were used for taxonomic assignment: Min Support: 5, Min Score: 35, Top percent: 10, Win Score: 0, Min Complexity: 0. This process resulted in the generation of sample specific RMA files used by MEGAN for downstream analysis. These files contain all of the taxonomic assignment information for each sample. Global metagenome comparisons using all sequences assigned to all taxa were completed for each cohort. These comparisons used MEGAN's normalization protocol enabling inter-sample comparison. Additionally, sequences contained in specific taxonomic subsets (bacteria, viruses, or phage) were isolated and processed through MEGAN using the same parameters. Similarly, sequences from specific phage taxa (caudovirales, microviridae, leviviridae and unclassified phage) were extracted and compared. This procedure permitted independent analysis of these taxa without artifactual effects of global normalization. Summarized sequence counts per taxa were exported for subsequent statistical analysis using Graph Pad Prism version 5.0d.

PCR Detection of Viruses

Primers (Table 1) were designed to amplify regions conserved between WUHARV adenoviruses 1-5, caliciviruses 1-2, calicivirus 3, parvoviruses 1-2, enteroviruses 1-3, sapeloviruses 1-3, and related viral genomes. Primer sensitivity was evaluated using libraries with high or low numbers of adenovirus, calicivirus, parvovirus, enterovirus, or sapelovirus sequences, while primer specificity was evaluated using libraries with high numbers of unrelated virus sequences, as well as virus sequences from related genera. Libraries generated from stool samples were diluted 10 fold and screened (n=2) for presence of viruses using: 10×PCR buffer 2.5 ul, MgCl$_2$ (25 mM) 2.5 ul, dNTP (2 mM) 2.5 ul, forward primer (10 uM) 0.5 ul, reverse primer (10 uM) 0.5 ul, Taq 0.3 ul, and H$_2$O 6.2 ul. PCR products were amplified at: 95° C., 5 min; 95° C., 30 sec, 60° C., 30 sec, 72° C., 1 min, for 32 cycles; 72° C., 10 min and then visualized using EtBr on a 1.5% agarose gel. There was concordance in all duplicate tests.

TABLE 1

Primers

| WUHARV Virus | Primer name | Targeted region | Sequence (5'-3') | SEQ ID NO: | Orientation |
|---|---|---|---|---|---|
| Adenovirus 1 | 4302c3f | Hexon | GGCAATCATGATGGACACCTT | 332 | F |
| Adenovirus 1 | 4302c3r | Hexon | TTAATCACCACCGCAACGC | 333 | R |
| Adenovirus 1 | 4302c1f | Hexon | CAATGGAACATTAATCCCACG | 334 | F |

TABLE 1-continued

Primers

| WUHARV Virus | Primer name | Targeted region | Sequence (5'-3') | SEQ ID NO: | Orientation |
|---|---|---|---|---|---|
| Adenovirus 1 | 4302c1r | Hexon | CCTGCCAACACTCCCATATTT | 335 | R |
| Adenovirus 1 | 4302c18f | E1B | AGAGCTATCACACAGCGTTCA | 336 | F |
| Adenovirus 1 | 4302c18r | E1B | ACCGAGTGGTGGAGGAGAA | 337 | R |
| Adenovirus 2 | 4310ac18f | pIIIa | TAACGTTCAGACCAATCTGGA | 338 | F |
| Adenovirus 2 | 4310ac18r | pIIIa | CGGCAATAGTGCTACTGTTGG | 339 | R |
| Adenovirus 2 | 4310ac16f | Hexon | CGGGACAACTTCATTGGACT | 340 | F |
| Adenovirus 2 | 4310ac16r | Hexon | GCGCCAATGTTTACAAAGGT | 341 | R |
| Adenovirus 3 | 4310bc18f | pIIIa | TAACGTTCAGACCAATCTGGA | 342 | F |
| Adenovirus 3 | 4310bc18r | pIIIa | CGGCAATAGTGCTACTGTTGG | 343 | R |
| Adenovirus 3 | 4310bc21f | Hexon | ACGACAGCACCAGTTCAAAAC | 344 | F |
| Adenovirus 3 | 4310bc21f | Hexon | TTTTCTGGCAGCGTGATGTT | 345 | R |
| Adenovirus 3 | 4310bc28r | E3 | CTCTTGGCAACCCCTTATTG | 346 | F |
| Adenovirus 3 | 4310bc28f | E3 | TGGGTGAAACCATTCCTGTT | 347 | R |
| Adenovirus 4 | 4312u11r | E3 | CCGTCCTCTCCTGGTAGAAA | 348 | F |
| Adenovirus 4 | 4312u11f | E3 | CGTCGACTGTTGGAGAAACA | 349 | R |
| Adenovirus 4 | 4312u10r | DBP | GCCGTTACATCCAGATCCTC | 350 | F |
| Adenovirus 4 | 4312u10f | DBP | TACACCGAGGGAATGAAAGC | 351 | R |
| Adenovirus 4 | 4312u7r | NCR[1] between E1a and E1b | CTTGTGCCTGTGCTTTTCAT | 352 | F |
| Adenovirus 4 | 4312u7f | NCR between E1a and E1b | GTGCAAAGAGAACTAGTATGG | 353 | R |
| Adenovirus 5 | 4287u7f | Iva | GGATGTTCAAGTACATGGGCA | 354 | F |
| Adenovirus 5 | 4287u7r | Iva | GATGCATGACAAGTTCCCCA | 355 | R |
| Adenovirus 5 | 4287c5f | E3 | GAATGGTAGCTGCTTTCTTCA | 356 | F |
| Adenovirus 5 | 4287c5r | E3 | TGTTGGGTGATTGTGATGGA | 357 | R |
| Adenovirus 5 | 4287c11f | Fiber-1 | CTGAAAAAAACGAATTGGTGG | 358 | F |
| Adenovirus 5 | 4287c11r | Fiber-1 | TTGACAACAATGGTGCGTTG | 359 | R |
| Adenovirus (1-5) | AdV-aGG | pIIIa | ACTAACGTKCAGACCAATCT | 360 | F |
| Adenovirus (1-5) | AdV-b | pIIIa | GTACAGRCTCACGGACTGC | 361 | R |
| Calicivirus (1-2) | CV-a | NS[2] polyprotein | GTACGAYGTCGGAGGGACC | 362 | F |
| Calicivirus (1-2) | CV-b | NS polyprotein | GRTCACAAGCCATGACACTCAG | 363 | R |

TABLE 1-continued

Primers

| WUHARV Virus | Primer name | Targeted region | Sequence (5'-3') | SEQ ID NO: | Orientation |
|---|---|---|---|---|---|
| Calicivirus 3 | CV-c | NS polyprotein | TTATGTTATGGACAACCCAAAGG | 364 | F |
| Calicivirus 3 | CV-d | NS polyprotein | GGTCAAGAGACAATAGCTCCAT | 365 | R |
| Parvovirus (1-3) | PV-a | capsid | ACCAGACTAACWCAAGGCGC | 366 | F |
| Parvovirus (1-3) | PV-b | capsid | GGTASGTGTTCCATTGTCTTGG | 367 | R |
| Enterovirus (1-3) | EV-a | 5'UTR[3] | GCACAACCCCAGTGTAGTTC | 368 | F |
| Enterovirus (1-3) | EV-b | 5'UTR | CCAATCCAATMGCTATATGATGAC | 369 | R |
| Sapelovirus (1-3) | SV-a | 5'UTR | CCAGKMTAAAAGGCAATTGTGG | 370 | F |
| Sapelovirus (1-3) | SV-b | 5'UTR | CCTGTCAGGTAGCACTAGACT | 371 | R |

[1]NCR = non-coding region
[2]NS = non-structural
[3]UTR = untranslated region

Isolation and Detection of WUHARV Adenoviruses

Stool samples from rhesus monkeys #30, 40, and 44 were diluted in media, passed through a 0.45-μm filter, and used to inoculate a T-25 flask containing an E1 complementing cell line such as PerC6 or Per55K cells maintained as previously described (Abbink et al., J. Virol. 81: 4654-4663 (2007)). Upon 100% cell lysis, cells and supernatant were harvested and frozen at −20° C. Viruses were plaque purified twice. Briefly, MW6 plates were seeded with Per55K cells on day 1. On day 0 cells were infected with log dilutions of virus. On day 1 an agar overlay was performed, plates were incubated until plaques were big enough to pick, and plaques picked and amplified in a well of a 24 well plate. Virus stocks were then generated and virions purified. Briefly, virus was amplified to inoculate 24 T-175 triple layer flasks. Cells were harvested and virus particles purified using CsCl. To detect adenoviruses, primers (Supplementary Table 1) were designed to amplify regions from WUHARV adenoviruses (1-5) from contigs with a range of relatedness to the reference genomes. Crude lysate, plaques and purified virus were screened for presence of adenovirus using: 2 ul DNA, 25 ul Phusion Master Mix with HF buffer, 1.5 ul 100% DMSO, 2 ul forward primer (10 uM), 2 ul reverse primer (10 uM), 17.5 ul H$_2$O. PCR products were amplified at: 98° C. 30 sec; 98° C. 10 sec, 50° C. 10 sec, 72° C. 30 sec for 30 cycles; 72° C. 10 min. and then visualized using EtBr on a 0.8% agarose gel.

Assays and Necropsy of SIV-Infected Rhesus Monkeys

Serum levels of LPS binding protein (LBP) were quantitated by ELISA (Antibodies Online). Twelve animals housed at the NEPRC were subjected to complete necropsy within two hours of death and representative sections of all major organs were collected, fixed in 10% neutral buffered formalin (NBF), embedded in paraffin, sectioned at 5 μm, and stained using haematoxylin and eosin (HE). Following histopathologic examination, additional immunohistochemistry was used to analyze the degree of adenovirus infection within the small and large intestinal sections. The specific adenovirus immunohistochemistry protocol was as follows: deparaffinization and rehydration followed by a 5' block in 3% hydrogen peroxide; pre-treatment with proteinase K for 5 minutes; all steps were followed by a tris-buffered saline (TBS) wash. Prior to application of primary antibodies, all slides were treated with both a biotin block and a Dako protein block for 10 minutes each. Sections were incubated with anti-mouse adenovirus known to cross react with 41 known serovars of adenovirus (Millipore (Billerica, Mass., USA), monoclonal, 1:200) overnight at 4° C. This was followed by 30 minute incubation at room temperature with Vectastain ABC standard. All slides were developed with DAB chromagen (Dako) and counterstained with Mayer's haematoxylin. In all cases, step sections were incubated with isotype-specific irrelevant antibodies for negative controls and failed to show staining. Positive controls consisted of sections of small intestine positive for adenovirus.

GenBank Accession Numbers

Sequence data from each animal were uploaded to the MG-RAST server (version 3.12). The sequences of viral contigs presented in FIG. 5 have been uploaded to GenBank with the following numbers: WUHARV Calicivirus 1 (JX627575), WUHARV Parvovorius 1 (JX627576), WUHARV Enterovirus 1 (JX627570), WUHARV Enterovirus 2 (JX627571), WUHARV Enterovirus 3 (JX627572), WUHARV Sapelovirus 1 (JX627573), and WUHARV Sapelovirus 2 (JX627574).

Statistical Analysis

Figures 9A, 9B:
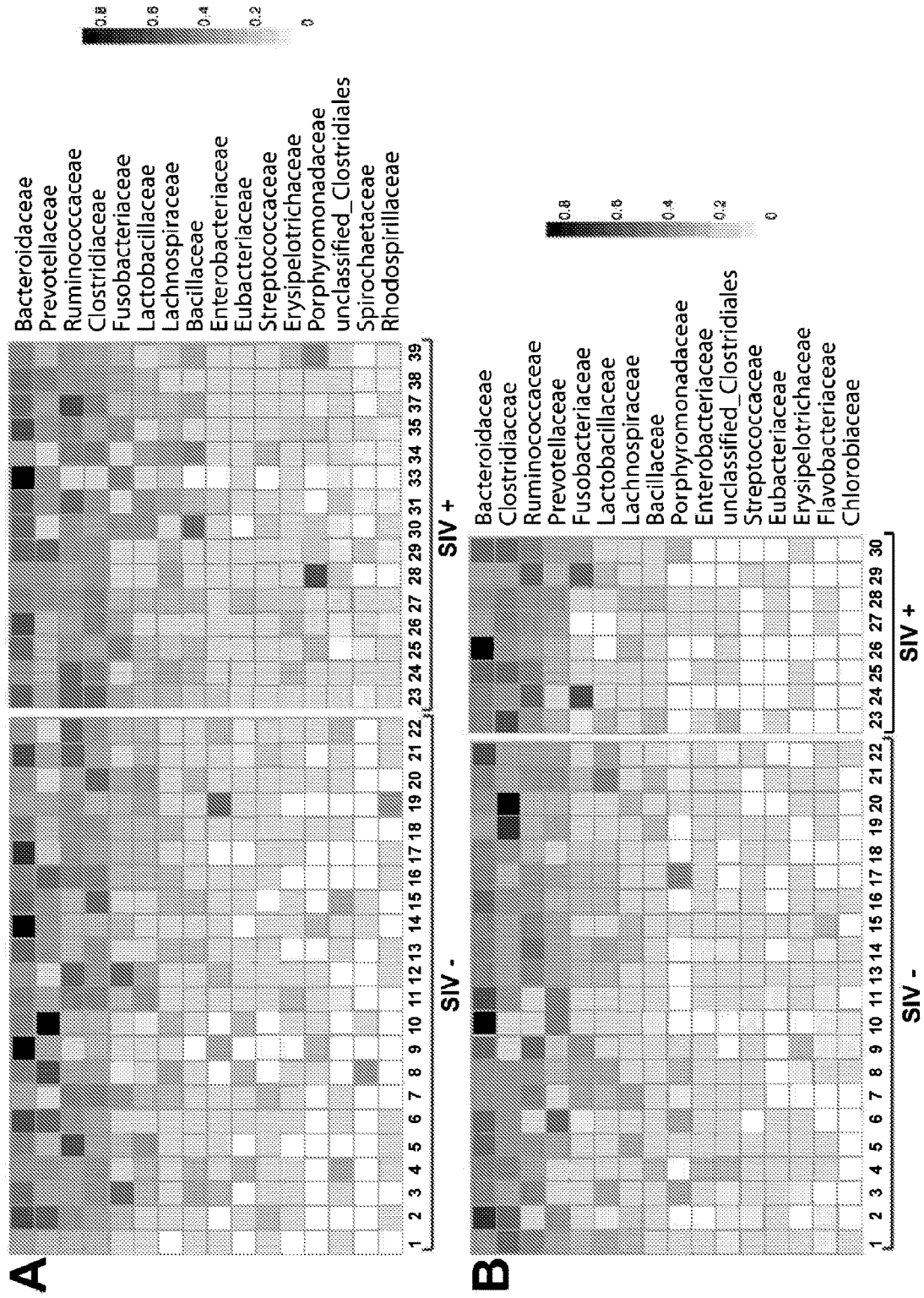
FIG. 9A is a heatmap displaying the number of sequences assigned to specific bacterial families for each individual pathogenic SIV-infected and control rhesus monkey housed at the NEPRC 24 weeks after SIV infection. The nature of SIV infection is as defined for FIG. 1A.
FIG. 9B is a heatmap displaying the number of sequences assigned to specific bacterial families for each individual pathogenic SIV-infected and control rhesus monkey housed at the NEPRC 64 weeks after SIV infection. The nature of SIV infection is as defined for FIG. 1B.

For analysis of sequence numbers after normalization the data were $\log_{10}$ transformed prior to statistical analysis. P-values were derived using the nonparametric Mann-Whitney test. P-values <0.05 are considered significant. For analysis of bacterial families in FIG. 9, we utilized one-way ANOVA with a Bonferroni correction to correct for multiple comparisons.

Construction of Phylogenetic Trees

We performed phylogenetic analysis for viruses with sufficient sequence information as defined by contig length is >90% of full length of the most closely related viruses shown in FIG. 5. Multiple sequence alignments were performed with ClustalW (Thompson et al. Nucleic Acids Res. 22: 4673-4680 (1994)). Phylogenetic analysis was performed using the neighbor-joining method in the PHYLIP package (Felsenstein, Phylogeny Inference Package, Department of Genome Sciences, University of Washington, Seattle (2005)) with 100 bootstrap replicates. Phylogenetic trees were visualized using TreeView (Page, CABIOS. 12: 357-358 (1996)).

Caliciviridae Sequences Used for Phylogentic Trees

The predicted amino acid sequences of the full length polyprotein from WUHARV Calicivirus 1 were used to construct a phylogenetic tree. Polyproteins from following viruses were used: Bovine calicivirus (BoCAA09480.1), Calicivirus pig/F15-10/CAN (CV pig F15-10, ACQ44561.1), Calicivirus pig/AB104/CAN (CV pig AB104, ACQ44563.1), Calicivirus pig/NC-WGP93C/USA/2009 (CV pig NC-WGP93C, ADG27878.1), Calicivirus pig/AB90/CAN (CV pig AB90, YP_002905325.1), Norovirus Hu/GII-4/Niigata2/2008/JP (BAJ13866.1), Norovirus dog/GVI.1/HKU_Ca026F/2007/HKG (ACV89839.1), Norovirus genogroup 3 (AFQ00092.1), Norovirus Bo/Newbury2/1976/UK (AAD16174.5), Norwalk-like virus (AAM95184.2), Norwalk virus (NP_056820.1), Tulane Virus (ACB38131.1), and WUHARV Calicivirus 1 (JX627575).

Parvoviridae Sequences Used for Phylogentic Trees

The predicted amino acid sequences of the near full length nonstructural 1 protein from WUHARV Parvovirus 1 were used to construct the phylogenetic tree. Polyproteins from following viruses were used: Bufavirus 1 (AFN44273.1), Bufavirus2 (AFN44276.1), Canine parvovirus (CP-V_AEK69509, AEK69509.1), Canine parvovirus (CPV_AAV54174, AAV54174.1), Feline panleukopenia virus (FPV_BAA 19018, BAA 19018.1), Feline panleukopenia virus (FPV_AAC37927, AAC37927.1), Kilham rat virus (AAC40695.1), LuIII virus (NP_821154.1), Mink enteritis virus (AEO92090.1), Minute virus of mice (ABB01353.1), Mouse parvovirus 1 (NP_042345.1), Mouse parvovirus 2 (YP_656490.1), Parvovirus H1 (NP_040318.1), Porcine parvovirus (ADN94624.1), Porcine parvovirus (ADN94588.1), and WUHARV Parvovirus 1 (JX627576).

Picornaviridae Sequences Used for Phylogentic Trees

The full length genome of WUHARV Enterovirus 1, 2, 3, WUHARV Sapelovirus 1 and 2 were used to construct the phylogenetic tree. Genome sequences of following viruses were used: Baboon enterovirus strain A13 (BaboonEV A13, AF326750.2), Duck picornavirus TW90A (AY563023.1), Enterovirus 75 strain USA/OK85-10362 (EV 75, AY556070.1), Human echovirus 11, isolate HUN-1108 (HEchoV 11, AJ577589.1), Human enterovirus 71 strain BJ08-Z025-5 (HEV 71, FJ606450.1), Human enterovirus 90 (HEV 90, AB192877.1), Human enterovirus 92 strain RJG7 (HEV 92, EF667344.1), Human coxsackievirus A2 strain CVA2/SD/CHN/09 (HCoxV A2, HQ728259.1), Human coxsackievirus A5 strain CVA5/SD/CHN/09 (HCoxV A5, HQ728261.1), Human coxsackievirus A7 strain Parker (HCox A7, AY421765.1), Porcine enterovirus 8 strain V13 (PSV-1, Porcine sapelovirus 1, AF406813.1), Porcine sapelovirus strain csh (PSV_csh, HQ875059.1), Simian enterovirus 46 strain RNM5 (SimianEV 46, EF667343.1), Simian enterovirus SV19 strain M19s (SV19, AF326754.2), Simian enterovirus SV43 strain OM112t (SV43, AF326761.2), Simian sapelovirus 1 strain 2383 (SimianSV-1, AY064708.1), WUHARV Enterovirus 1 (JX627570), WUHARV Enterovirus 2 (JX627571), WUHARV Enterovirus 3 (JX627572), WUHARV Sapelovirus 1 (JX627573), and WUHARV Sapelovirus 2 (JX627574).

Example 2

Next Generation Sequencing Analysis Reveals Expansion of the Enteric Virome During Pathogenic SIV Infection Defining the Enteric Virome To define the effects of pathogenic and non-pathogenic SIV infection on the enteric virome, we shotgun sequenced libraries of fecal RNA+DNA from four independent cohorts of monkeys, each comprising SIV-infected and uninfected control animals. Two cohorts of pathogenically SIV-infected and uninfected control rhesus monkeys were housed at the New England Primate Research Center (NEPRC) or the Tulane National Primate Research Center (TNPRC) (Table 2). As expected, the set point of SIV in the serum correlated with rapid progression to AIDS and death. The NEPRC cohort was sampled at both 24 and 64 weeks after SIV infection. Two cohorts of non-pathogenically SIV-infected and uninfected control African green monkeys were housed at the National Institutes of Health (NIH, vervet monkeys) or the NEPRC (sabaeus monkeys) (Table 2).

Total RNA+DNA from fecal material were sequenced using 454 technology to leverage the resulting long sequences for robust assessment of taxonomy and assembly of viral genomes (Table 2). There was no statistical correlation between SIV infection status and either the number of total or unique sequences (viral plus other) obtained within any of the four cohorts. For each cohort, sequences were analyzed by two different computational approaches. In the first method, the taxonomic structure of the sequences was analyzed using MEGAN version 4.62.3 (build Nov. 22, 2011 (Huson et al., *Genome. Res.* 17: 377-386 (2007); Huson et al., *BMC Bioinformatics* 10(Suppl 1): S12 (2009))). Each sequence was compared to the non-redundant (nr) database using BLASTX and results mapped to the NCBI Taxonomy Database. Sequences assigned to bacterial families or classes were extracted and used for subsequent analysis. The second computational approach was a custom pipeline called VirusHunter developed to identify novel viruses via analysis of both nucleic acid and protein similarity (Presti et al., *J. Virol.* 83: 11599-11606 (2009); Loh et al., *J. Virol.* 83: 13019-13025 (2009); Zhao et al., *J. Virol.* 85: 10230-10238 (2011); Felix et al., *PLoS Biol.* 9: e1000586 (2011); Loh et al., *J. Virol.* 85: 2642-2656 (2011)).

TABLE 2

Cohorts and sequences analyzed

| Animal cohort | Type of monkey | Animal numbers | | Total sequences (average length) | Unique sequences (average length) | Sequences per sample | Unique sequences per sample |
|---|---|---|---|---|---|---|---|
| NEPRC[1] (24 wpi[2]) | Rhesus Control | 22 | 22 SIV+ | 899,947 (358 bp) | 356,521 (357 bp) | 4,689-51,870 | 594-26,838 |
| NEPRC (64 wpi) | Rhesus Control | 22 | 12 SIV+ | 705,429 (341 bp) | 263,430 (345 bp) | 6,132-59,847 | 1,080-33,982 |

TABLE 2-continued

Cohorts and sequences analyzed

| Animal cohort | Type of monkey | Animal numbers | | Total sequences (average length) | Unique sequences (average length) | Sequences per sample | Unique sequences per sample |
|---|---|---|---|---|---|---|---|
| TNPRC[3] | Rhesus | 29 Control | 13 SIV+ | 1,409,046 (296 bp) | 557,518 (294 bp) | 9,188- 89,974 | 3,666- 33,613 |
| NIH[4] | African green | 19 Control | 19 SIV+ | 1,382,171 (300 bp) | 425,524 (301 bp) | 3,259- 127,567 | 1,382- 33,464 |
| NEPRC | African green | 6 Control | 10 SIV+ | 612,612 (293 bp) | 187,807 (279 bp) | 8,287- 194,880 | 2,118- 55,158 |

[1]New England Primate Research Center
[2]wpi = weeks post-infection with SIV
[3]Tulane National Primate Research Center
[4]National Institutes of Health Enteric Virome of Rhesus Monkeys Housed at the NEPRC We first analyzed the enteric virome of 44 rhesus monkeys housed at the NEPRC comprised of 22 monkeys infected intrarectally with pathogenic SIVmac251 and 22 SIV-uninfected monkeys (herein termed controls) (FIGS. 1A, 1B, 2A, and 2B). Per standard husbandry procedures, SIV-infected and control rhesus monkeys were fed the same diet but housed separately. Analysis of this cohort confirmed SIV viremia in infected animals and revealed the expected decreases in CD4 T cell counts and increases in serum LBP levels consistent with intestinal leakage and consequent systemic immune activation at both 24 and 64 weeks after infection (FIGS. 3A-3C). We collected fecal specimens either at 24 (FIGS. 1A and 2A) or 64 weeks (FIGS. 1B and 2B) after SIV infection. Between these two collection times 10 SIV-infected rhesus monkeys were euthanized for progressive AIDS. As expected, the set point level of SIV in the serum of rhesus monkeys correlated with rapid progression to AIDS and death. No control animals died.

Figures 2A, 2B, 2C:
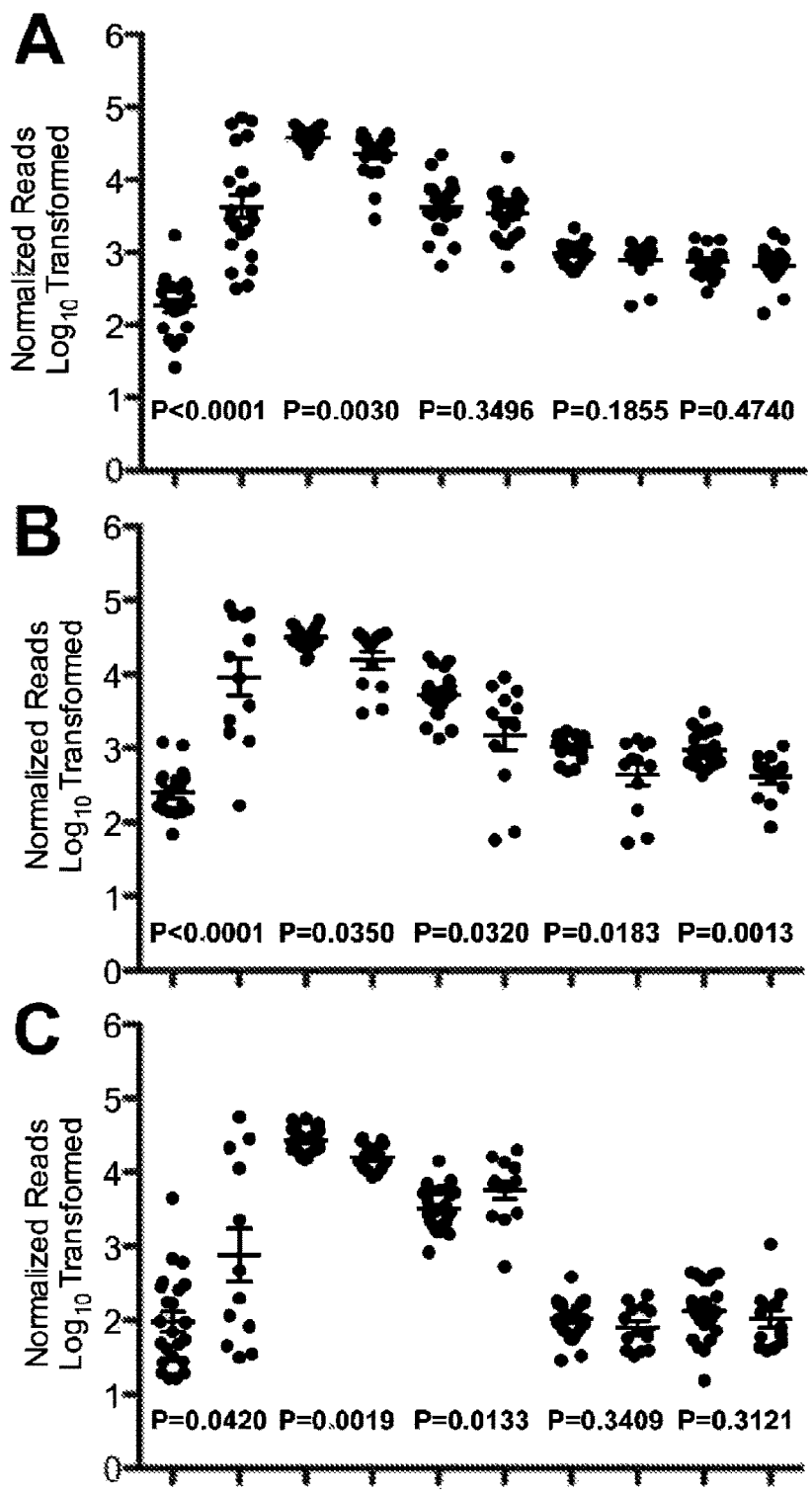
FIG. 2A is a graph showing the quantitation of sequences from different kingdoms of life identified in the feces of pathogenic SIV-infected and control rhesus monkeys housed at the NEPRC 24 weeks after SIV infection. The nature of SIV infection is as defined in the FIG. 1A.
FIG. 2B is a graph showing the quantitation of sequences from different kingdoms of life identified in the feces of pathogenic SIV-infected and control rhesus monkeys housed at the NEPRC 64 weeks after SIV infection. The nature of SIV infection is as defined in the FIG. 1B.
FIG. 2C is a graph showing the quantitation of sequences from different kingdoms of life identified in the feces of pathogenic SIV-infected and control rhesus monkeys housed at the TNPRC. The nature of SIV infection is as defined in the FIG. 1C.
Figures 3A, 3B, 3C:
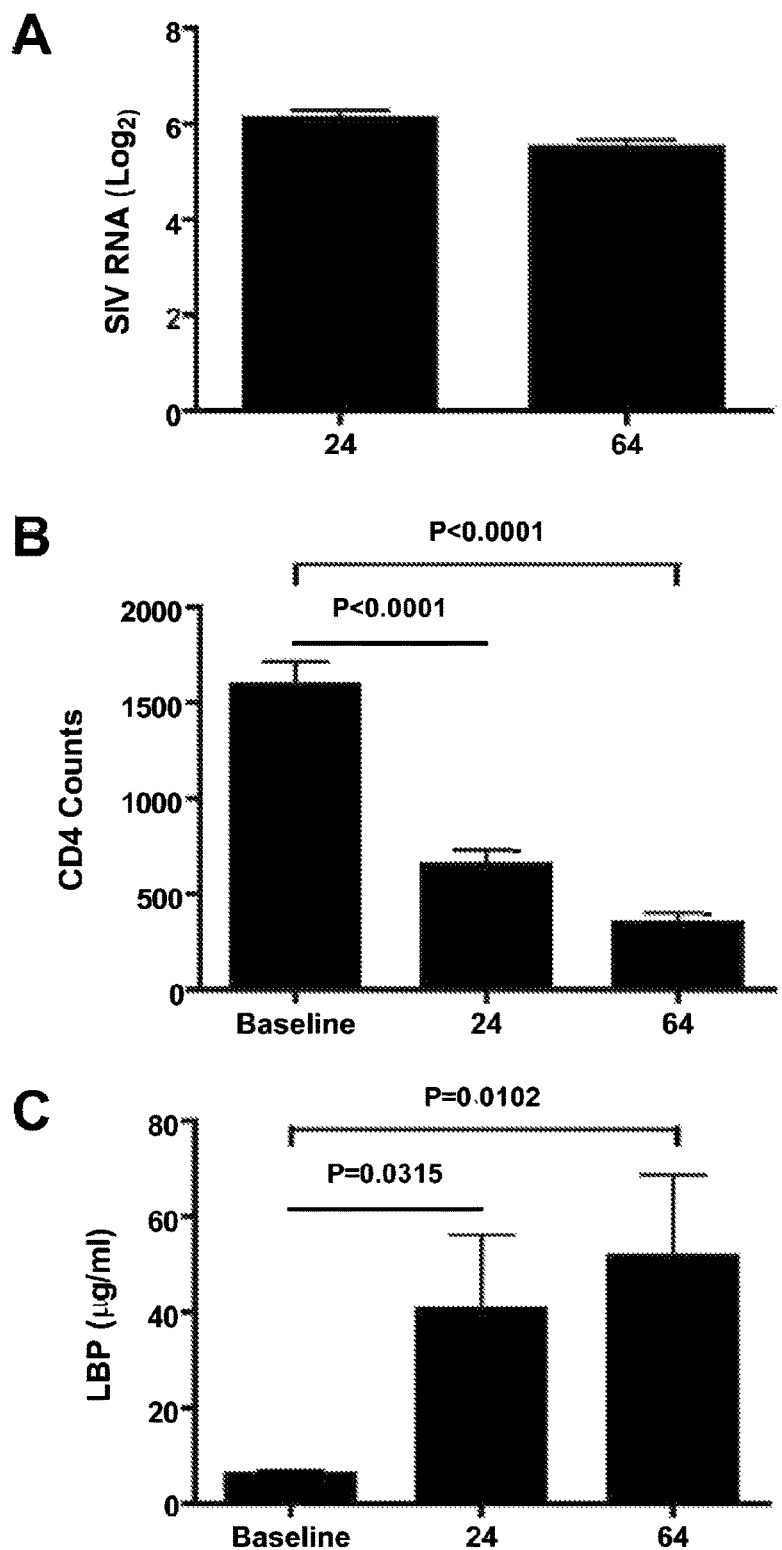
FIG. 3A is a graph showing SIV RNA levels in animals in the NEPRC cohort.
FIG. 3B is a graph showing CD4 T cell (CD4) numbers in animals in the NEPRC cohort.
FIG. 3C is a graph showing serum LPS binding protein (LBP) levels in animals in the NEPRC cohort.

SIV infection was associated with a greater than 10-fold increase in the number of sequences from viruses ($p<0.0001$) and a decrease in sequences from bacteria ($p=0.003$) at 24 weeks post-infection (FIGS. 1A and 2A). At this time after SIV infection, there were no statistically significant SIV-associated changes in the total number of sequences from phages, alveolata (representing protists), viridiplantae (representing food sequences from plants), or other kingdoms and phyla (FIGS. 1A and 2A). Samples collected 40 weeks later (64 weeks after SIV infection) revealed increases in viral sequences in most of the surviving animals that showed low numbers of viral sequences 24 weeks after SIV infection (e.g., compare animals 23, 31, and 33 between FIGS. 1A and 1B). Differences between SIV-infected and control monkeys, similar to those observed at 24 weeks after SIV infection, were observed for both viral ($p<0.0001$) and bacterial ($p=0.035$) sequences at 64 weeks after infection (FIGS. 1B and 2B). By 64 weeks after SIV infection, the surviving SIV-infected monkeys showed significant decreases in the number of phage ($p=0.0320$), alveolata ($p=0.0183$), and viridiplantae ($p=0.0013$) sequences compared to controls (FIG. 2B). These data suggest that pathogenic SIV infection is associated with significant expansion in the enteric virome.

Enteric Virome of Rhesus Monkeys Housed at the TNPRC

Figures 1C, 1D, 1E:
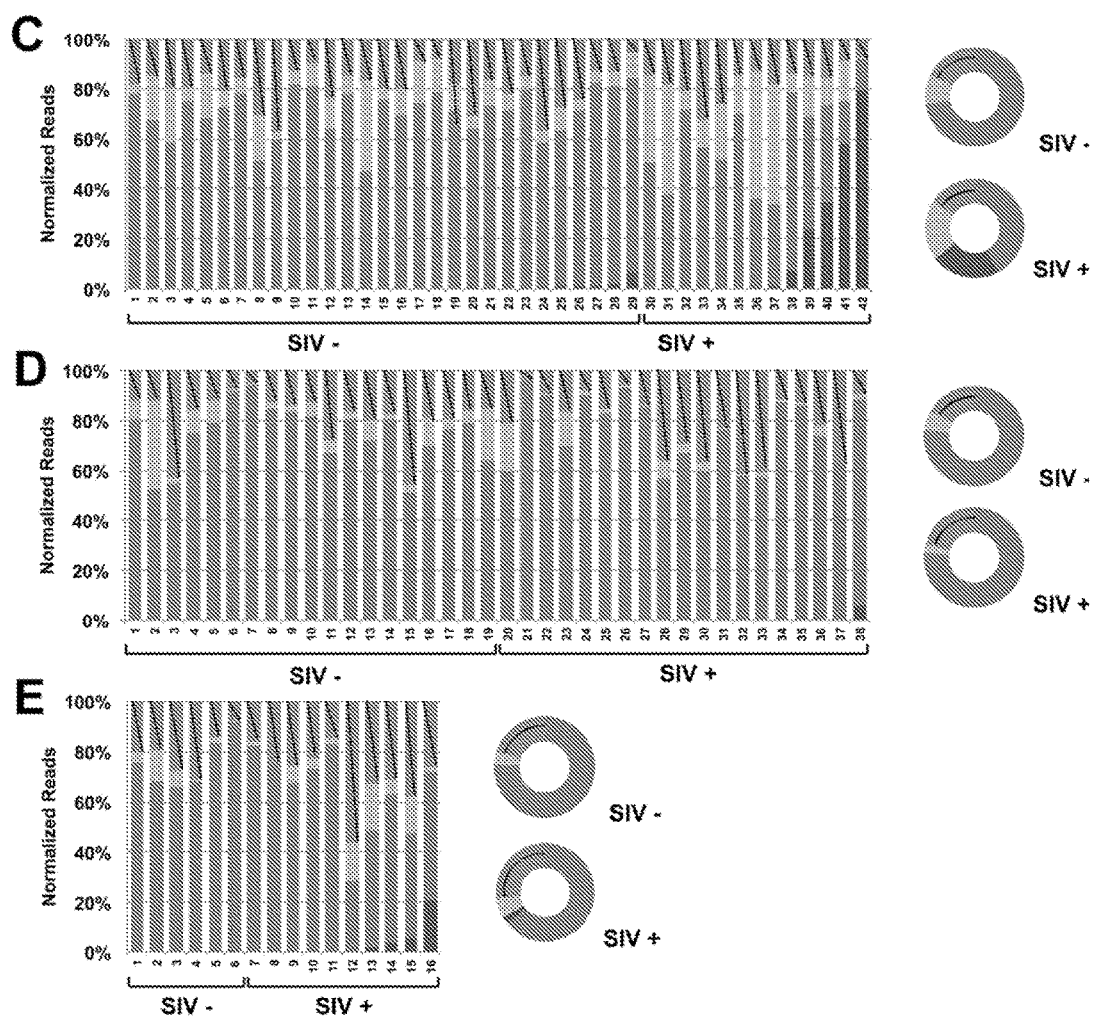
FIG. 1C is a graph showing the taxonomic distribution of sequences identified in feces of pathogenic SIV-infected (SIV+) and uninfected (SIV−) control rhesus monkeys housed at the TNPRC 23-64 weeks after intravaginal infection with SIVmac251. The flanking doughnut chart displays the averaged values per kingdom for SIV+ or SIV− monkeys.
FIG. 1D is a graph showing taxonomic distribution of sequences identified in feces of non-pathogenic SIV-infected (SIV+) and control (SIV−) vervet African green monkeys housed at the NIH at least three years after intravenous infection with SIVagm90, SIVagmVer1, or after natural infection in the wild. The flanking doughnut chart displays the averaged values per kingdom for SIV+ or SIV− monkeys.
FIG. 1E is a graph showing the taxonomic distribution of sequences identified in feces of non-pathogenic SIV-infected (SIV+) and control (SIV−) sabaeus African green monkeys housed at the NEPRC and infected intravenously with SIVagmMJ8, SIVagm9315BR, or uninfected controls. The flanking doughnut chart displays the averaged values per kingdom for SIV+ or SIV− monkeys.

To confirm our findings in pathogenically SIV-infected rhesus monkeys housed at the NEPRC, we analyzed an independent cohort of 13 rhesus monkeys infected intravaginally with SIVmac251 and 29 control rhesus monkeys housed at the TNPRC (Table 2; FIGS. 1C and 2C). SIV infection at the TNPRC was associated with a significant increase in viral sequences ($p=0.0420$) and decrease in bacterial sequences (0.0019). In the TNPRC cohort, the SIV-infected monkeys showed significant increases in the number of phage ($p=0.0133$) sequences (FIGS. 1C and 2C). Similar to the 24 week time point in the NEPRC cohort there were no significant changes in sequences from phage, alveolata, viridiplantae, or sequences from other kingdoms and phyla (FIGS. 1C and 2C). These results confirm that an expansion of the enteric virome is associated with pathogenic SIV infection in two independent cohorts of rhesus monkeys.

Enteric Virome of African Green Monkeys

Figures 2D, 2E:
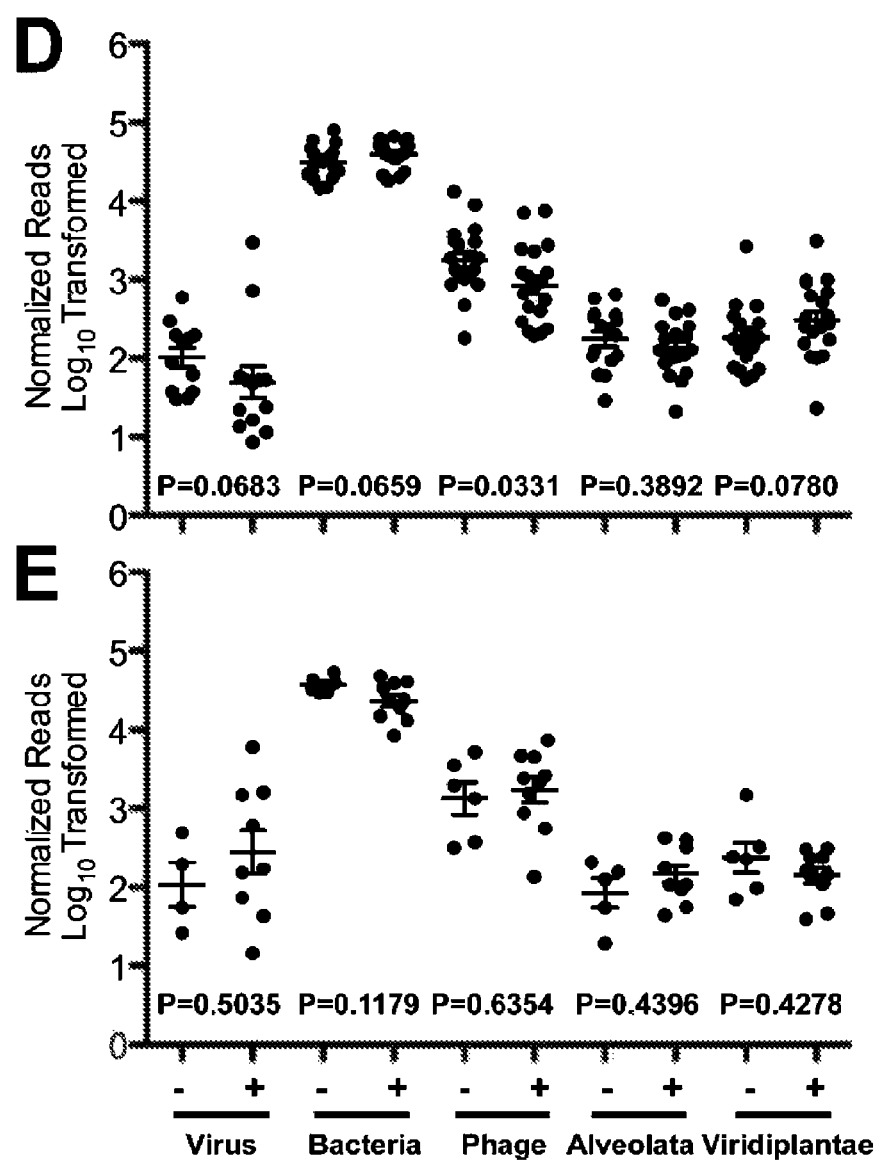
FIG. 2D is a graph showing the quantitation of sequences from different kingdoms of life identified in the feces of nonpathogenic SIV-infected and control vervet African green monkeys housed at the NIH. The nature of SIV infection is as defined in the FIG. 1D.
FIG. 2E is a graph showing the quantitation of sequences from different kingdoms of life identified in the feces of nonpathogenic SIV-infected and control sabaeus African green monkeys housed at the NEPRC. The nature of SIV infection is as defined in the FIG. 1E.

We next assessed whether the pathogenic SIV infection-associated changes in the enteric virome observed in rhesus monkeys (FIGS. 1A-1C and 2A-2C) were also seen during non-pathogenic SIV infection in African green monkeys (Table 2; FIGS. 1D-1E and 2D-2E). The vervet African green monkey cohort housed at the NIH (FIGS. 1D and 2D) was comprised of six monkeys infected intravenously with SIVagm90, two monkeys infected intravenously with SIVagmVer1, 11 monkeys naturally infected with SIV, and 19 uninfected control animals. The cohort of sabaeus African green monkeys housed at the NEPRC (Table 2; FIGS. 1E and 2E) was comprised of two monkeys infected intravenously with SIVagmMJ8, 8 monkeys infected intravenously with SIVagm9315BR and 6 uninfected control animals. Analysis of these two sets of sequences revealed an increase in phage sequences in the NIH cohort ($p=0.0331$) that was not observed in the NEPRC cohort, but no other significant SIV infection-associated changes were observed in either cohort including for the virome (FIGS. 1D-1E and 2D-2E). These data indicate that the expansion of the enteric virome observed during pathogenic SIV infection is not observed during non-pathogenic SIV infection. Importantly, these African green monkeys had been infected with non-pathogenic SIV for a prolonged period (a minimum of 3 years for the NIH cohort, and from 27 weeks (2 animals) to 2.6 years (8 animals) for the NEPRC cohort). Therefore, the lack of an increase in viral sequences in these SIV-infected animals is not attributable them being infected for a shorter time than the pathogenically SIV-infected rhesus monkeys analyzed above.

Example 3

Viruses Present in SIV-Infected Rhesus and African Green Monkeys

Figures 4A, 4B, 4C:
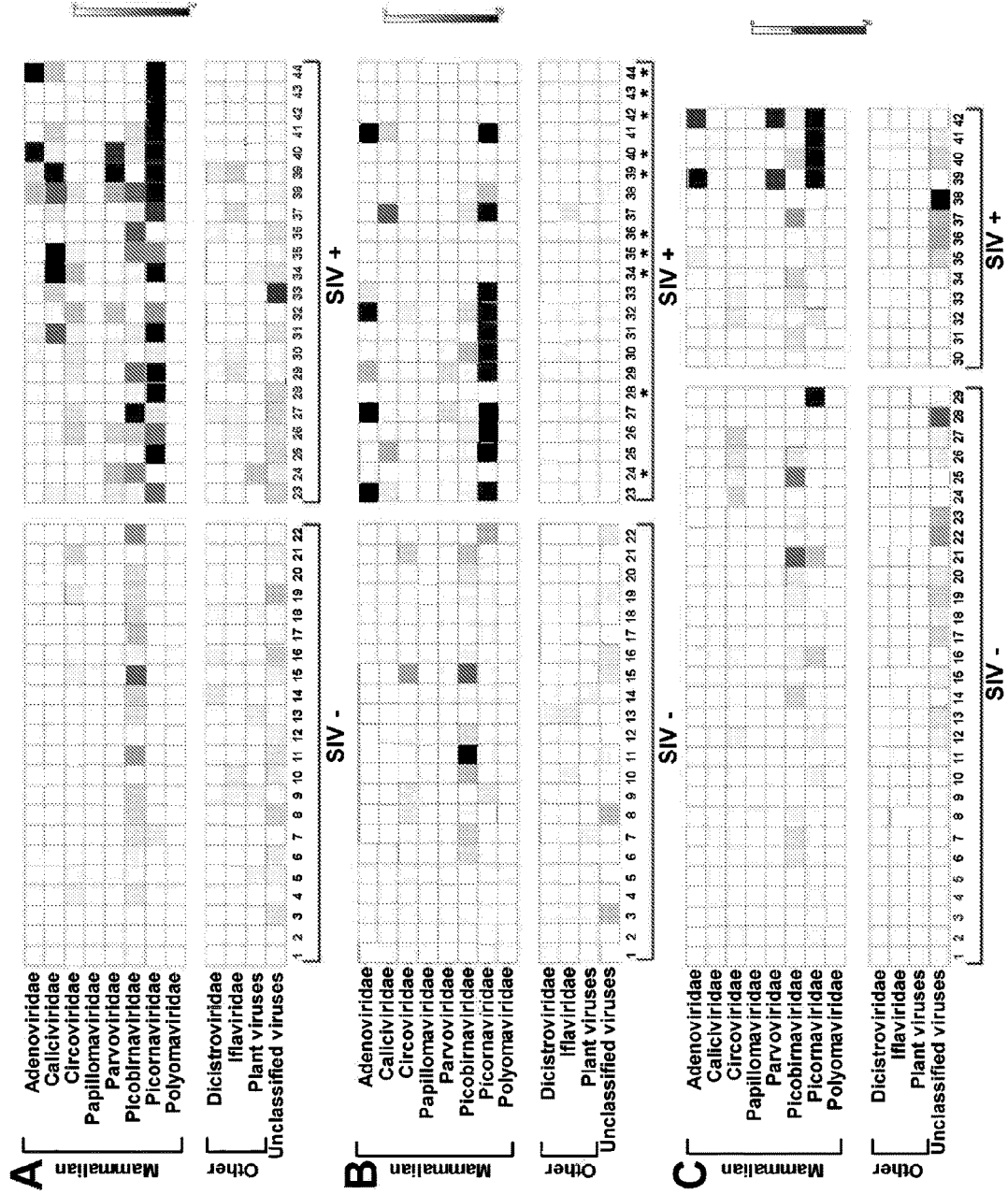
FIG. 4A is a chart showing the distribution of virus sequences present in the feces of pathogenic SIV-infected and control rhesus monkeys housed at the NEPRC 24 weeks after SIV infection. "Mammalian" indicates that sequences were most closely related to viruses that infect mammals. Viruses infecting non-mammals are referred to as "other." "Unclassified viruses" includes all unclassified viruses, e.g., Chronic bee paralysis virus, Chimpanzee stool associated circular ssDNA virus, Circovirus-like genome RW-C, Circovirus-like genome CB-A, and Rodent stool-associated circular genome virus.
FIG. 4B is a chart showing the distribution of virus sequences present in the feces of pathogenic SIV-infected and control rhesus monkeys housed at the NEPRC 64 weeks after SIV infection. * indicates euthanized for progressive AIDS between 24 and 64 weeks after SIV infection. Virus classifications as described in FIG. 4A.
FIG. 4C is a chart showing the distribution of virus sequences present in the feces of pathogenic SIV-infected and control rhesus monkeys housed at the TNPRC. Virus classifications as described in FIG. 4A.

We next defined the nature of the viral sequences that we detected in SIV-infected and uninfected monkeys using VirusHunter software (Presti et al., *J. Virol.* 83: 11599-11606 (2009); Loh et al., *J. Virol.* 83: 13019-13025 (2009); Zhao et al., *J. Virol.* 85: 10230-10238 (2011); Felix et al., *PLoS Biol.* 9: e1000586 (2011); Loh et al., *J. Virol.* 85: 2642-2656 (2011)). When a nucleotide sequence did not have significant similarity to the genome of an already sequenced virus, we analyzed the predicted translation products and selected the most closely related virus in the database for comparison. This analysis allowed us to determine which types of viruses were detected in individual animals in each cohort (FIGS. 4A-4E). Using conservative criteria we detected at least 32 distinct and previously undescribed viruses in the sequences generated from individual rhesus monkeys housed at the NEPRC alone (FIGS. 4A and 4B). Certain viruses were found in multiple different animals, indicating shared exposure to enteric viruses. We did not count circoviruses in this estimate due to their ubiquity and diversity. Importantly, we found no significant differences in known insect (Dicistroviridae, Iflaviridae) or plant viruses, which are presumably derived from the diet, comparing SIV-infected animals and control animals in any cohort (FIGS. 4A-4E). The lack of differences in viruses from insects and plants between SIV-infected and SIV uninfected monkeys provides an important internal control indicating that the process of library construction and analysis does not artificially expand the number of mammalian viral sequences in samples from SIV-infected rhesus monkeys.

Figures 4D, 4E, 4F:
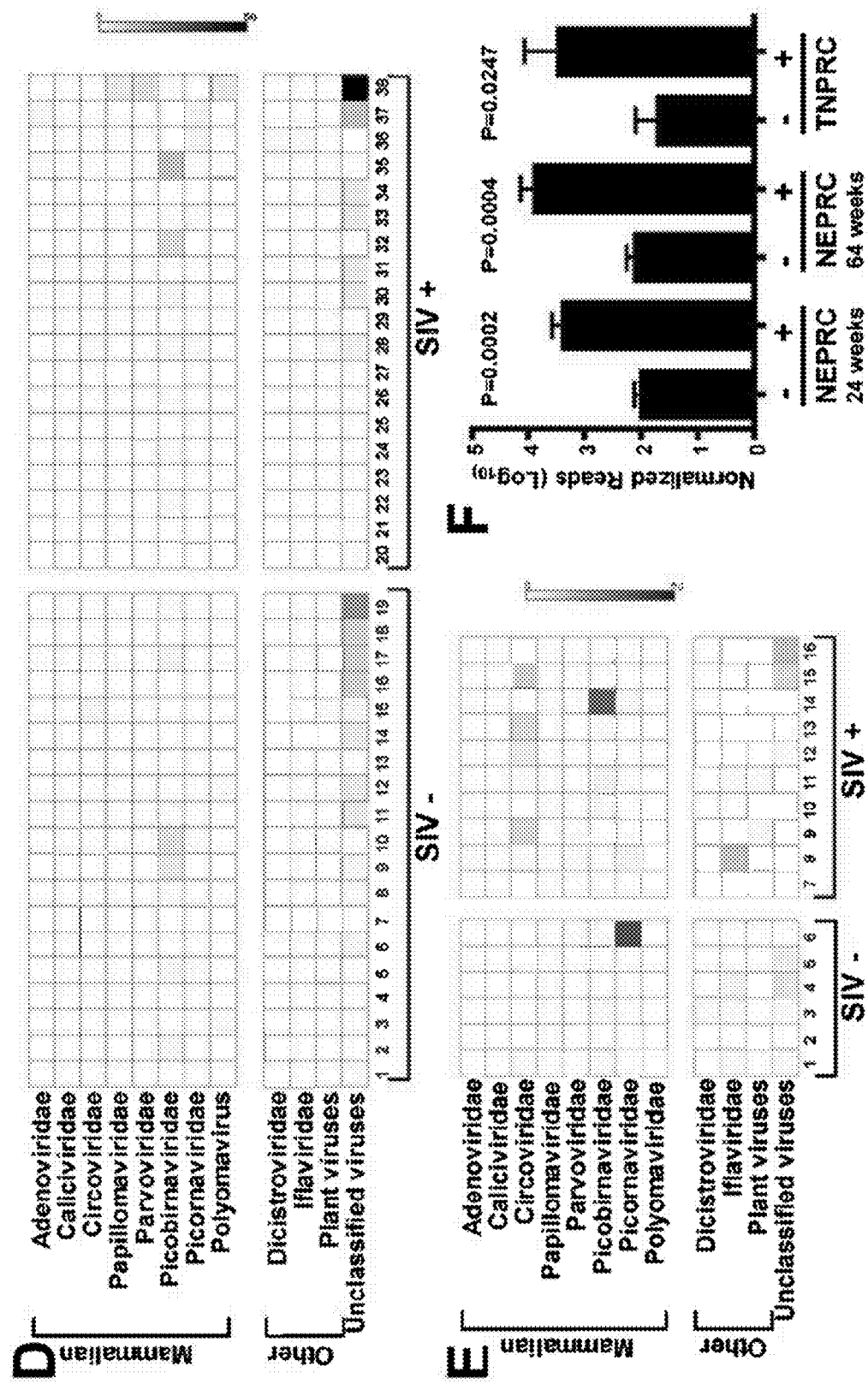
FIG. 4D is a chart showing the distribution of virus sequences present in the feces of non-pathogenic SIV-infected and control vervet African green monkeys housed at the NIH. Virus classifications as described in FIG. 4A.
FIG. 4E is a chart showing the distribution of virus sequences present in the feces of non-pathogenic SIV-infected and control sabaeus African green monkeys housed at the NEPRC. (C) Viruses present in feces of pathogenic SIV-infected and control rhesus monkeys housed at the TNPRC. Virus classifications as described in FIG. 4A.
FIG. 4F is a graph showing the average number of picornavirus sequences, after normalization for analysis using MEGAN, detected in the indicated cohorts of SIV-infected (+) and control (−) rhesus monkeys.

Newly identified viruses included five adenoviruses, three caliciviruses, one papillomavirus, seven members of the Parvoviridae (2 parvovirus/amdoviruses, five dependoviruses, and one bocavirus), seven picobirnaviruses, and seven members of the Picornavirales (three enteroviruses, 3 sapeloviruses, and one picornavirus), and one polyomavirus (FIGS. 4A and 4B; Table 3). Importantly, many SIV-infected rhesus monkeys at both the NEPRC and the TNPRC were shedding multiple potentially pathogenic viruses (FIGS. 4A-4C). The presence of multiple novel viruses, and of individual animals infected with multiple distinct viruses, was not regularly observed in control rhesus monkeys housed at the same locations. In striking contrast, cohorts of African green monkeys housed at either the NEPRC or the NIH were relatively free of virus infection whether SIV-infected or not (FIGS. 4D and 4E).

As previously observed by others using classical virologic methods (Wang et al., *J. Med. Primatol.* 36: 101-107 (2007); Oberste et al., *J. Gen. Virol.* 88: 3360-3372 (2007); Oberste et al., *J. Virol.* 76: 1244-1251 (2002); Sasseville et al., *J. Immunotoxicol.* 7: 79-92 (2010); Bailey et al., *Vet. Pathol.* 47: 462-481 (2010)), picornaviruses were detected in both control and SIV-infected rhesus monkeys (FIG. 4; Table 3). This allowed us to compare the number of sequences detected from pathogenic SIV-infected rhesus monkeys versus control animals (FIG. 4F). In monkeys housed at either the NEPRC or the TNPRC there were significant increases in the number of sequences derived from picornaviruses in SIV-infected animals compared to controls (p=0.0002 and 0.0004 for the NEPRC rhesus animals at 24 or 64 weeks of infection, p=0.0247 for the TNPRC rhesus animals). No relationship was detected between picornavirus sequences and SIV with non-pathogenic SIV infection of African green monkeys. These data are consistent with a failure to control picornavirus infection in association with pathogenic SIV infection.

TABLE 3

Summary of viruses identified in Rhesus macaques at the NEPRC

| Virus family | Virus name[1] | Name of most closely related virus[2] | Percent identity nt or aa[3] (length, nt or aa) | Animal(s) in which viruses were detected[4] | | | |
|---|---|---|---|---|---|---|---|
| | | | | 24 weeks | | 64 weeks | |
| | | | | SIV− | SIV+ | SIV− | SIV+ |
| Adenoviridae | WUHARV Adenovirus 1 | Simian adenovirus 1 ATCC VR-195 | 79-99% nt | — | 40[5]* | — | 23 |
| | WUHARV Adenovirus 2 | Human adenovirus G | 36-100% nt | — | 44* | — | — |
| | WUHARV Adenovirus 3 | Human adenovirus G | 36-100% nt | — | 44* | — | — |
| | WUHARV Adenovirus 4 | Human adenovirus G | 87-93% nt | — | 30 | — | — |
| | WUHARV Adenovirus 5 | Human adenovirus G | 48-100% nt | — | — | — | 27 |
| Caliciviridae | WUHARV Calicivirus 1 | Tulane virus | 75% nt (4839/6489) | — | 25, 26, 31, 33, 34*, 35*, 37, 38, 39*, 40*, 41, 44* | — | 23, 25 |
| | WUHARV Calicivirus 2 | Tulane virus | 88-93% nt (4463/5082, 753/812) | — | 37 | — | 30, 37, 41 |
| | WUHARV Calicivirus 3 | Rhesus macaque recovirus strain FT437 | 0-81% nt (50/64, 2881413, 216/268) | — | 23, 28*, 32, 39* | — | — |
| Papillomaviridae | WUHARV Papillomavirus 1 | Human papillomavirus | 69% nt (300/432) | 15 | 25 | — | 32 |

TABLE 3-continued

Summary of viruses identified in Rhesus macaques at the NEPRC

| | | | | Animal(s) in which viruses were detected[4] | | | |
| | | Percent identity nt or aa[3] | | 24 weeks | | 64 weeks | |
| Virus family | Virus name[1] | Name of most closely related virus[2] | (length, nt or aa) | SIV− | SIV+ | SIV− | SIV+ |
|---|---|---|---|---|---|---|---|
| Parvoviridae | WUHARV Bocavirus 1 | Human bocavirus isolate KU3 | 73% nt (118/160) | — | — | — | 29 |
| | WUHARV Dependovirus 1 | Adeno-associated virus 11 | 93% nt (3812/4090) | — | 40* | — | 29 |
| | WUHARV Dependovirus 2 | Adeno-associated virus 10 | 92% nt (3680/4020) | — | 23, 30, 31, 32, 34*, 38, 39*, 40*, 44* | — | 27, 29 |
| | WUHARV Dependovirus 3 | Adeno-associated virus isolate rh.31 | 94% nt (1680/1793) | — | 40* | — | — |
| | WUHARV Dependovirus 4 | Adeno-associated virus isolate rh.8R | 86% nt (988/1145) | — | 37, 40* | — | — |
| | WUHARV Dependovirus 5 | Adeno-associated virus 7 | 86% nt (264/307) | — | 26 | — | — |
| | WUHARV Parvovirus 1 | Bufavirus 2 | 77% nt (1626/2111) | 7 | 24*, 31, 33, 38, 39* | — | 25, 37 |
| | WUHARV Parvovirus 2 | Bufavirus 2 | 75-79% nt (522/698, 139/175) | — | 35* | — | 27 |
| Picobirnaviridae | WUHARV Picobirnavirus 1 | Human picobirnavirus | 26% aa (147/574) | — | 26, 36* | — | — |
| | WUHARV Picobirnavirus 2 | Otarine picobirnavirus | 29% aa (119/415) | 14, 11 | — | — | — |
| | WUHARV Picobirnavirus 3 | Human picobirnavirus | 29% aa (102/354) | 8, 15 | — | — | — |
| | WUHARV Picobirnavirus 4 | Human picobirnavirus | 36% aa (94/260) | — | 27 | — | — |
| | WUHARV Picobirnavirus 5 | Human picobirnavirus | 34% aa (63/187) | 22 | 37 | — | — |
| | WUHARV Picobirnavirus 6 | Human picobirnavirus | 37% aa (55/149) | — | 36* | — | — |
| | WUHARV Picobirnavirus 7 | Human picobirnavirus | 33% aa (101/302) | — | 27 | — | — |
| Picornaviridae | WUHARV Enterovirus 1 | Human enterovirus 92 strain RJG7 | 86% nt (6228/7268) | — | 41, 44* | — | — |
| | WUHARV Enterovirus 2 | Simian enterovirus SV19 strain M19s | 83% nt (5879/7100) | — | 23, 25, 26, 27, 29, 31, 35*, 38, 39* | — | 25, 29, 30, 32, 33, 38, 41 |
| | WUHARV Enterovirus 3 | Simian enterovirus SV19 strain M19s | 84% nt (5854/6961) | — | — | — | 25, 26, 27, 29, 30, 33, 37, 41 |
| | WUHARV Picornavirus 1 | Simian picornavirus 6 | 85% nt (284/335) | — | 26 | — | — |
| | WUHARV Sapelovirus 1 | Simian sapelovirus 1 | 81% nt (6558/8087) | 19 | 25, 26, 29, 30, 31, 32, 34*, 35*, 38, 39*, 42*, 43* | 1, 11, 17, 19, 22 | 23, 25, 26, 30, 31, 32, 33, 37, 38 |
| | WUHARV Sapelovirus 2 | Simian sapelovirus 1 | 81% nt (6510/8076) | — | 25, 28*, 35*, 37, 41 | — | 29, 41 |
| | WUHARV Sapelovirus 3 | Simian sapelovirus 1 | 79% nt (5476/6919) | — | 23, 37, 40* | — | 27 |

TABLE 3-continued

Summary of viruses identified in Rhesus macaques at the NEPRC

| Virus family | Name of virus name[1] | Name of most closely related virus[2] | Percent identity nt or aa[3] (length, nt or aa) | Animal(s) in which viruses were detected[4] | | | |
|---|---|---|---|---|---|---|---|
| | | | | 24 weeks | | 64 weeks | |
| | | | | SIV− | SIV+ | SIV− | SIV+ |
| Polyomaviridae | WUHARV Polyomavirus 1 | Polyomavirus HPyV6 isolate 601a | 76% nt (242/318) | — | — | — | 29 |

[1]Viruses with 98% nt identity over the full length of aligned regions are the "same" virus.
[2]Most closely related viruses were identified as the top hit using a NCBI web-based BLAST search against the NCBI nr database on Aug. 31, 2012.
[3]Percent aa identity is reported for viruses for which no known virus had nt identity.
[4]As determined by 454 sequencing.
[5]Underlined numbers indicate animals from which virus contigs were assembled.
*Euthanized for progressive AIDS 24 to 64 weeks after SIV infection Genomic Analysis of Viruses in Rhesus Monkeys at the NEPRC We next analyzed the viruses present in the NEPRC cohort by assembling virus sequences from individual animals into contigs which could then be compared to the most closely related virus present in the database (see, e.g., FIGS. 5A-5D, 6A, and Table 3). Here, these viruses will be named using the convention "WUHARV-virus name-number." Even within a single animal we found contigs from distinct but related viruses, indicating that some animals were shedding more than one virus of the same genus (FIGS. 4, 5, and Table 3).

Figures 5A, 5B, 5C:
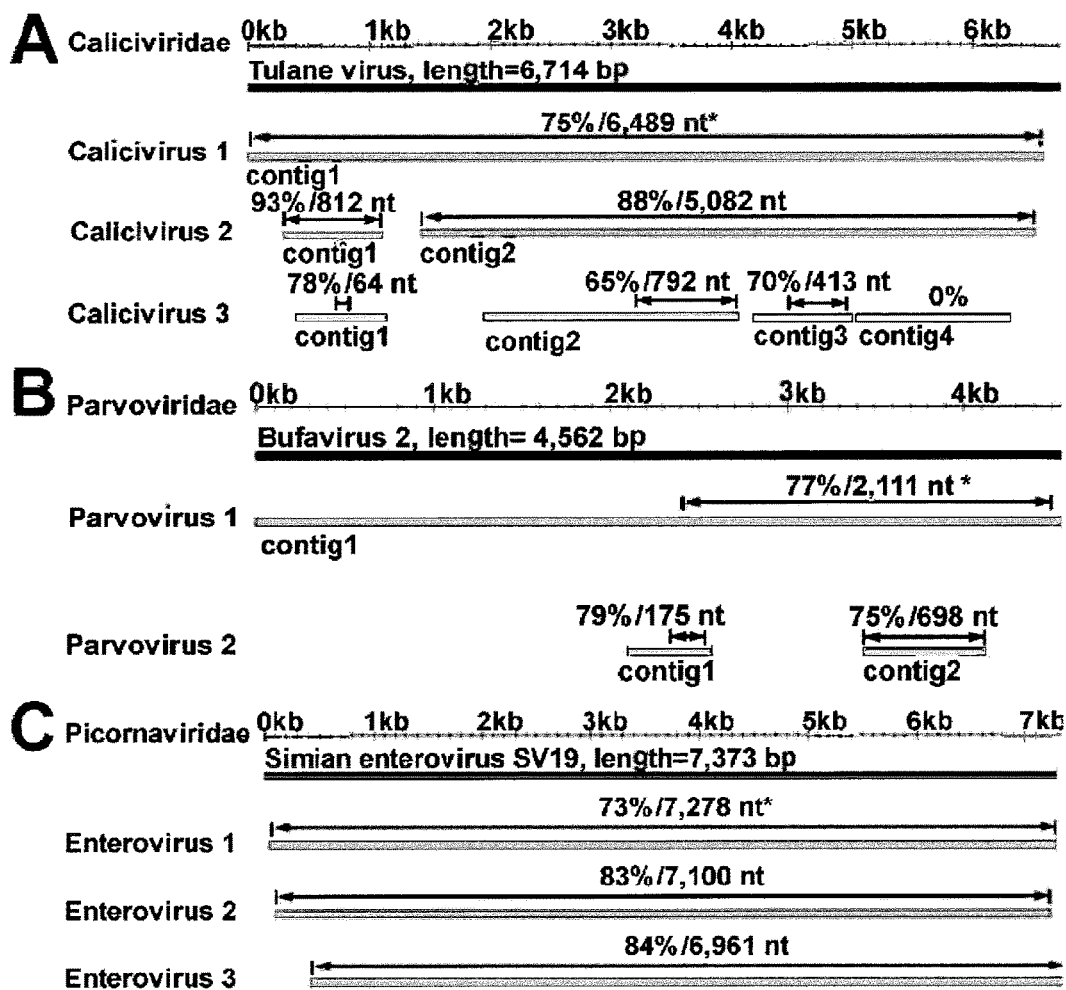
FIG. 5A are schematic diagrams showing the assembled viral contigs (in gray) from newly identified WUHARV Caliciviruses 1 (animal 39), 2 (from an animal not included in the cohort), and 3 (animal 39) compared to Tulane calicivirus (black bar). Calicivirus 1 contig 1 derived from 879 sequences, length=6578 bp; Calicivirus 2 contig 1 derived from 16 sequences, length=812 bp; Calicivirus 2 contig 2 assembled from 120 sequences, length=5083 bp; Calicivirus 3 contig 1 assembled from 14 sequences, length=750 bp; Calicivirus 3 contig 2 assembled from 67 sequences, length=2111 bp; Calicivirus 3 contig 3 assembled from 41 sequences, length=832 bp; Calicivirus 3 contig 4 assembled from 38 sequences, length=1273 bp. Animal numbers refer to the monkeys in FIG. 1A. *Indicates the percentage nucleotide identity over the designated length of the best aligned homologous region (indicated by double headed arrow) compared to the most closely related genome indicated in the black bar.
FIG. 5B are schematic diagrams showing the assembled viral contigs (in gray) from newly identified WUHARV Parvovirus 1 (animal 39) and 2 (animal 35) compared with the sequence of canine or mouse parvovirus 4a (black bars), as indicated. Parvovirus 1 contig 1 assembled from 375 sequences, length=4905 bp; Parvovirus 2 contig 1 representing 1 sequence, length=470 bp; Parvovirus 2 contig 2 assembled from 6 sequences, length=690 bp. Animal numbers refer to the monkeys in FIG. 1A. *Indicates the percentage nucleotide identity over the designated length of the best aligned homologous region (indicated by double headed arrow) compared to the most closely related genome indicated in the black bar.
FIG. 5C are schematic diagrams showing the assembled viral contigs (in gray) from newly identified WUHARV Enterovirus 1 (animal 41), 2 (animal 39) and 3 (animal 33) compared with the sequence of Simian enterovirus SV19 (black bar). Enterovirus 1 assembled from 1084 sequences, length=7273 bp; Enterovirus 2 assembled from 758 sequences, length=7128 bp; Enterovirus 3 assembled from 406 sequences, length=6962 bp. Animal numbers refer to the monkeys in FIG. 1A. *Indicates the percentage nucleotide identity over the designated length of the best aligned homologous region (indicated by double headed arrow) compared to the most closely related genome indicated in the black bar.
Figures 5D, 5E:
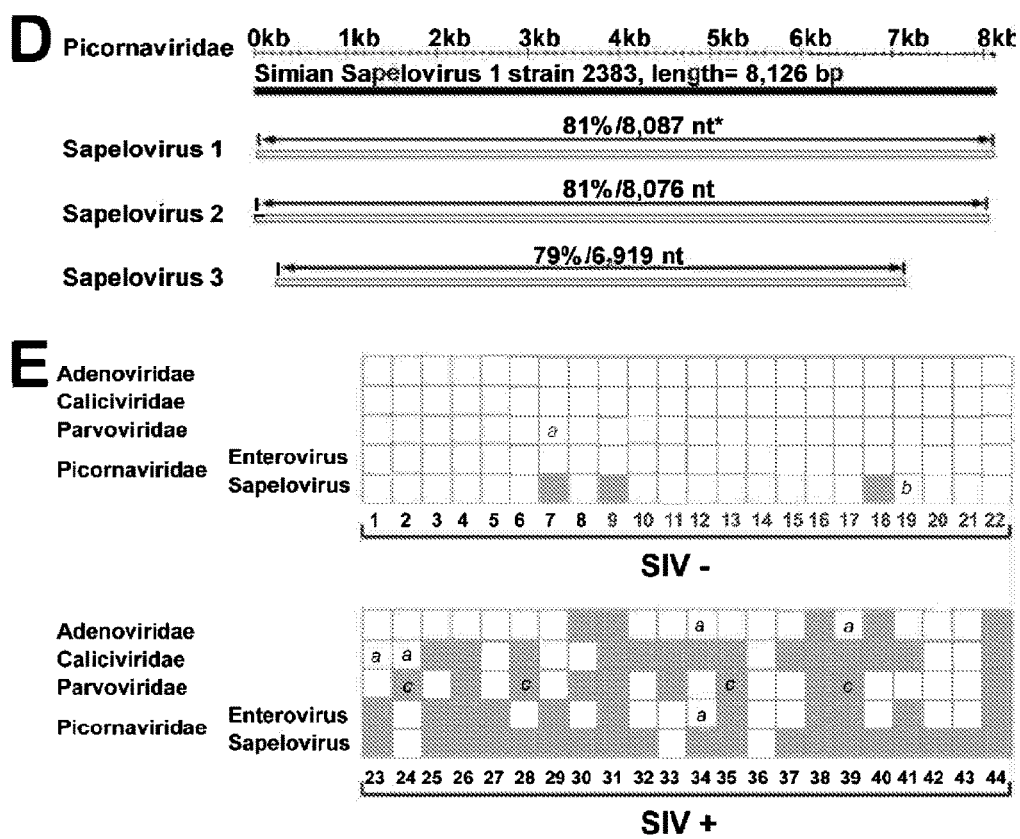
FIG. 5D are schematic diagrams showing the assembled viral contigs (in gray) from newly identified WUHARV Sapelovirus 1 (animal 42), 2 (animal 41) and 3 (animal 37) compared with the sequence of Simian Sapelovirus 1 strain 2383 (black bar). Sapelovirus 1 assembled from 3081 sequences, length=8059 bp; Sapelovirus 2 assembled from 2711 sequences, length=8025 bp; Sapelovirus 3 assembled from 380 sequences, length=6872 bp. Animal numbers refer to the monkeys in FIG. 1A. *Indicates the percentage nucleotide identity over the designated length of the best aligned homologous region (indicated by double headed arrow) compared to the most closely related genome indicated in the black bar.
FIG. 5E is a chart showing the presence of viral sequences as detected by PCR using virus-specific primers (Table 1). Numbers below the chart refer to the animals in FIG. 1A. "a" refers to lack of detection of a virus likely due to the presence of a divergent virus; "b" refers to lack of detection of a virus for unknown reasons; and "c" refers to detection of virus sequences in serum samples taken at the time of euthanasia for AIDS.
Figures 6A, 6B, 6C:
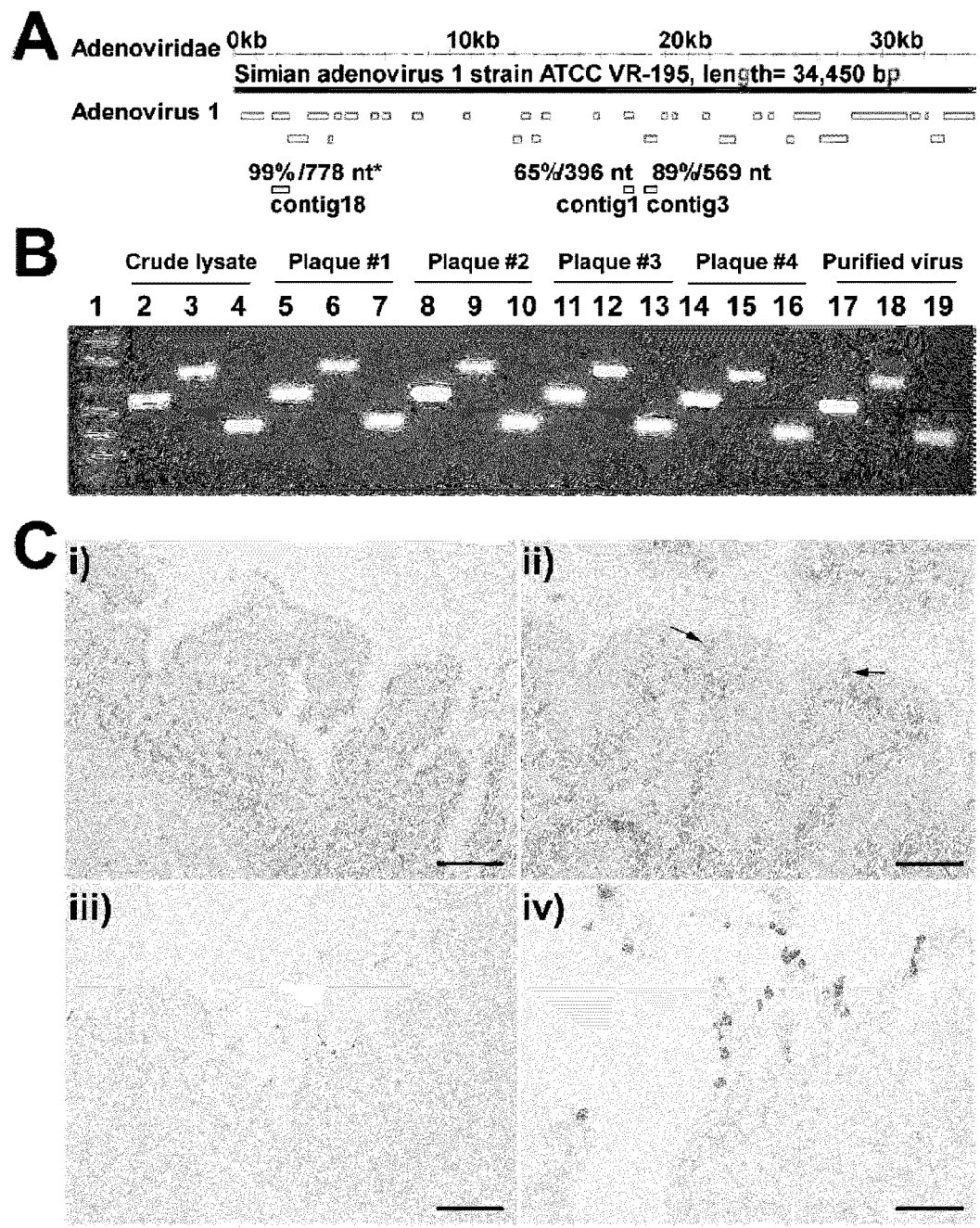
FIG. 6A are schematic diagrams showing the assembled viral contigs (in gray) from newly identified WUHARV Adenovirus 1 (animal #40) compared to the known virus Simian adenovirus 1 strain ATCC VR-195 (black bar). These contigs were assembled from 1308 sequences. Animal numbers refer to the monkeys in FIG. 1A. *Indicates the percentage nucleotide identity over the designated length of the best aligned homologous region (indicated by double headed arrow) compared to the most closely related genome indicated in the black bar.
FIG. 6B is an agarose gel showing PCR confirmation of WUHARV Adenovirus 1 during amplification, plaque purification, and cesium chloride gradient purification. The three PCR products for each sample (lanes 2-19) were derived from primers 4302c3f and 4302c3r, 4302c18f and 4302c18r, and 4302c1f and 4302c1 r, respectively (Table 1). Lane 1 is a molecular weight ladder.
FIG. 6C are images showing representative histopathology (top panels) and adenovirus immunohistochemistry (IHC) (bottom panels) for animal #23. Adenovirus infection was associated with villous atrophy and fusion (i) and sloughed epithelial cells that contained intranuclear adenoviral inclusions (arrows in (ii)). Adenovirus antigen could be localized to villous tip epithelium by immunohistochemistry (brown color of DAB chromagen, Mayer's counterstain; (iii) and (iv)). Scale bars in (i) and (iii) are 0.5 mm. Scale bars in (ii) and (iv) are 200 μm.
Figures 7A, 7B, 7C:
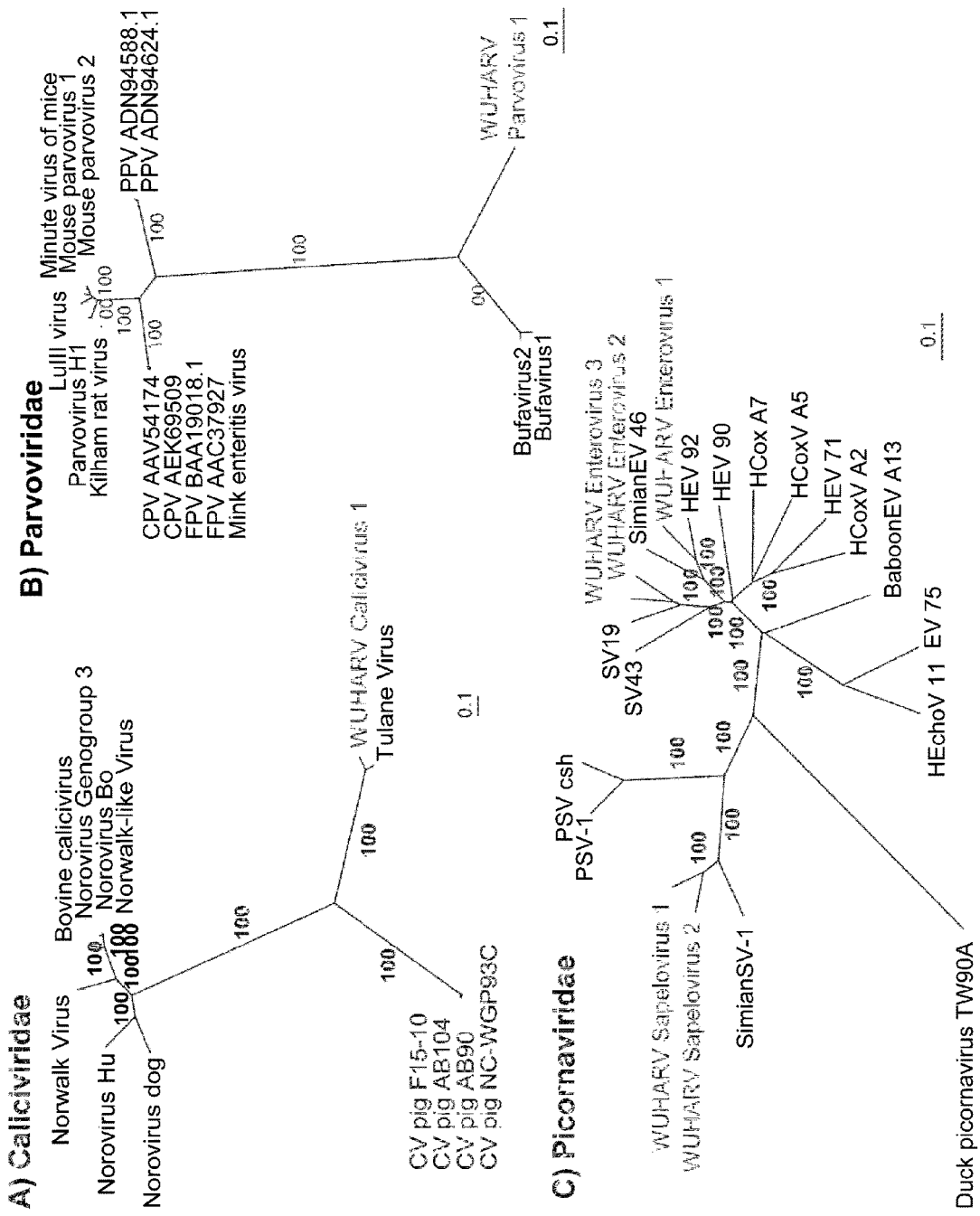
FIG. 7A is a diagram showing the neighbor-joining phylogenetic analysis of the predicted full-length non-structural polyprotein of WUHARV Calicivirus 1.
FIG. 7B is a diagram showing the neighbor-joining phylogenetic analysis of the predicted non-structural protein of WUHARV Parvovirus 1.
FIG. 7C is a diagram showing the neighbor-joining phylogenetic analysis of the full genome of WUHARV Enteroviruses 1, 2, and 3, and WUHARV Sapeloviruses 1 and 2.

We detected at least four adenoviruses (WUHARV Adenovirus 1-4) in the NEPRC cohort (FIG. 6A depicts WUHARV Adenovirus 1). We assembled portions of three calicivirus (WUHARV Caliciviruses 1-3) genomes (FIG. 5A). Importantly, WUHARV Caliciviruses 1 and 2 were most closely related to, but distinct from, the known primate calicivirus virus Tulane (Farkas et al., *J. Virol.* 82: 5408-5416 (2008); Farkas et al., *J. Gen. Virol.* 91: 734-738 (2010); Wei et al., *J. Virol.* 82: 11429-11436 (2008); Farkas et al., *J. Virol.* 84: 8617-8625 (2010)). For example, WUHARV Calicivirus 1 shared only 75% nucleotide identity over the 6,489-bp contig we assembled with Tulane calicivirus and was phylogenetically distinct from Tulane (FIG. 7A). WUHARV Calicivirus 3 was quite distantly related to either Tulane virus or to WUHARV Caliciviruses 1 and 2 (FIG. 5A). We detected parvoviruses most closely related to Bufavirus 2, a recently described parvovirus (Phan et al., *J. Virol.* [Epub ahead of print] (2012)) (FIGS. 5B and 7B). We assembled viral contigs covering most of the 7,000-8,000-bp genomes of several enteroviruses or sapeloviruses, both within the Picornaviridae (FIGS. 5C, 5D, and 7C). WUHARV Enteroviruses 1-3 share nucleotide similarity most closely with simian enterovirus SV19 with 73-84% nucleotide identity over a large portion of the genome. WUHARV Sapeloviruses 1-3 are most closely related to simian sapelovirus 1 strain 2383, sharing 79 to 81% nucleotide identity over essentially the entire genome. These data confirm that a remarkably wide variety of viruses are included within the expansion of the enteric virome associated with pathogenic SIV infection.

Next Generation Sequencing-Independent Confirmation of Virome Findings

We considered the possibility that relying on next generation sequencing (NGS) to document expansion of the enteric virome associated with pathogenic SIV infection might lead to false conclusions. For example, perhaps all detected viruses were present in multiple monkeys but the sequencing process is somehow biased by pathogenic SIV infection. To address this, we designed PCR assays to detect viruses for which we had large portions of the genome (FIG. 5E, Table 1) and used independent assays to detect viruses (FIG. 5E). PCR is a standard and sensitive diagnostic approach to detection of viruses in biological samples. In some cases the contigs were so divergent from each other that separate PCR assays had to be designed for different viruses in the same group. For example, one PCR assay was developed to detect WUHARV Caliciviruses 1 and 2 while a different assay was developed to detect WUHARV Calicivirus 3, which is highly divergent from all know caliciviruses. Overall PCR analysis correlated well with 454 detected viruses. PCR was positive for 454-detected viruses in 62/69 (90%) cases (FIG. 5E), with some of the failures potentially related to the presence of viruses that were divergent from the viruses used to design PCR primers. Consistent with this, PCR detected viruses in samples when as few as 1-2 viral sequences were detected in 454-derived datasets.

Compared to NGS, PCR detected 5/7 adenoviruses (failing to detect divergent adenoviruses in animals #34 and #39), 14/16 caliciviruses (failing to detect divergent caliciviruses in animals #23 and #24), 10/11 parvovirus genus members (parvoviridae, failing to detect a divergent parvovirus in animal #7), 11/12 enterovirus genus members (picornaviridae, failing to detect a divergent enterovirus in animal #34) and 22/23 sapelovirus genus members (picornaviridae, failing to detect a non-divergent virus in animal #19 representing a true false negative). Importantly, PCR was negative for virus infection in a total of 151/151 cases for adenoviruses, caliciviruses, parvoviruses, enteroviruses, and sapeloviruses when next generation sequencing followed by bioinformatic analysis did not reveal a viral sequence.

To further confirm NGS results, we cultured viruses from fecal samples. NGS data revealed (FIGS. 4A, 6A, and Table 3) that multiple animals at NEPRC were potentially infected by novel adenoviruses. We therefore selected fecal samples from four animals for potential isolation of adenoviruses. Within the NEPRC cohort we selected feces from animals #40 (60 adenovirus sequences), #44 (138 adenovirus sequences), and #30 (2 adenovirus sequences), as well as a fourth rhesus monkey not in this cohort (57 adenovirus sequences of 5,758 unique reads) and sought to isolate viruses from them. We cultured five adenoviruses from these four animals (WUHARV Ad#1-5). These viruses were sequentially plaque purified and then isolated on cesium chloride gradients. The identity of these purified viruses as the adenoviruses detected in 454 sequencing was confirmed by PCR and sequencing (WUHARV Ad1, shown in FIG. 6A). Together both PCR and culture analyses confirmed the presence of viruses detected by NGS in fecal samples from pathogenic SIV-infected animals.

Example 4

Figure 6D:
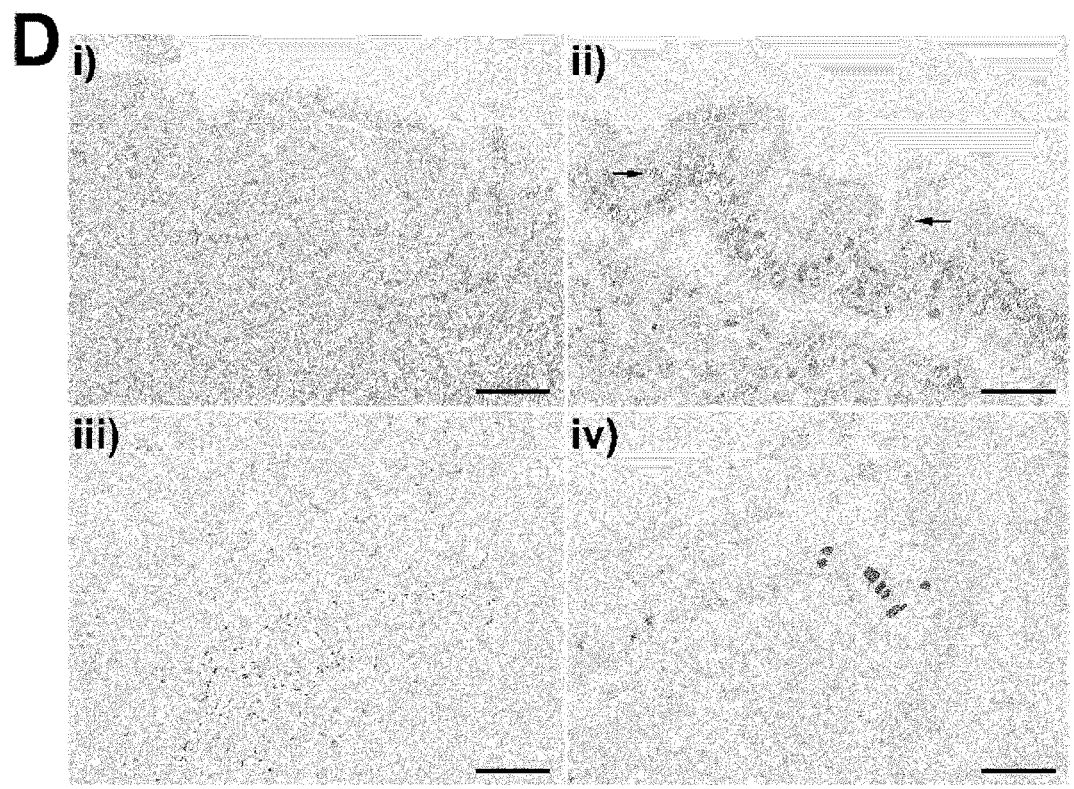
FIG. 6D are images showing representative histopathology (top panels) and adenovirus immunohistochemistry (IHC) (bottom panels) for animal #27. Adenovirus infection was associated with villous atrophy and fusion (i) and sloughed epithelial cells that contained intranuclear adenoviral inclusions (arrows in (ii)). Adenovirus antigen could be localized to villous tip epithelium by immunohistochemistry (brown color of DAB chromagen, Mayer's counterstain; (iii) and (iv)). Scale bars in (i) and (iii) are 0.5 mm. Scale bars in (ii) and (iv) are 200 µm.

Novel Viruses Detected by Next Generation Sequencing are Associated with AIDS Enteropathy We next considered the possibility that detection of viral sequences in feces would predict intestinal disease in SIV-infected rhesus monkeys. This is a key question because our other data demonstrate only that viruses are shed in feces. To determine if viruses detected by sequencing can be clinically significant we evaluated the small and large intestine of 12 SIV-infected rhesus monkeys housed at the NEPRC (FIG. 1B, results summarized in Table 4). Of the 12 animals necropsied, six had intestinal pathology characteristic of infection with cytomegalovirus or *Balantidium* (Table 4). Importantly, analysis of the fecal virome of these 12 animals revealed that three animals (#23, 27, and 41) had high levels of adenovirus sequences prior to necropsy (Table 4). These three rhesus macaques, but not others in this necropsy cohort, exhibited adenovirus-associated enteritis by histologic examination (FIGS. 6C and 6D, (i) and (ii)). Of these three monkeys with enteropathy, all had lesions in the jejunum and ileum (ileitis) while one also had lesions in the cecum (colitis). Immunohistochemistry for adenovirus confirmed the diagnosis of adenovirus ileitis and colitis (FIGS. 6C and 6D, (iii) and (iv)). Together these data demonstrate that viruses detected in the fecal material from SIV-infected rhesus monkeys using next generation sequencing can cause intestinal disease and epithelial damage in SIV-infected macaques.

To further investigate the clinical relevance of viruses detected by NGS, we used virus specific PCR assays (Table 1) to determine whether viruses detected in the fecal material of SIV-infected rhesus monkeys (FIGS. 4A and 5E) were present in serum. We detected parvovirus (FIG. 5E) in 4/10 serum samples taken at the time animals were euthanized for advanced AIDS between 24 and 64 weeks post-infection. Sequence analysis of PCR amplicons demonstrated that ¾ viruses present in fecal material (animals #24, #28, and #39) were also present in serum. This suggests that viruses detected in the fecal material of SIV-infected rhesus monkeys can invade tissues and enter the circulation, further supporting the conclusion that SIV-associated expansion of the enteric virus may contribute to disease.

TABLE 3

Summary of adenovirus detection and pathology in SIV-infected rhesus monkeys

| Animal number | Adenovirus reads[a] | WUHARV Adenovirus[a] | PCR screen[a,b] | Adenovirus Enteritis[c] | SI Adenovirus IHC[c] | LI Adenovirus IHC[c] | Other GI Pathologies[c] |
|---|---|---|---|---|---|---|---|
| 23 | 889 | 1, others[d] | Pos | Yes | Pos | Neg | *Cytomegalovirus* enteritis |
| 25 | 0 | n/a | Neg | No | Neg | Neg | No |
| 26 | 0 | n/a | Neg | No | Neg | Neg | No |
| 27 | 653 | 5, others[d] | Pos | Yes | Pos | Neg | *Balantidium* sp. typhlitis |
| 29 | 14 | others[d] | Neg | No | Neg | Neg | No |
| 30 | 1 | others[d] | Neg | No | Neg | Neg | No |
| 31 | 0 | n/a | Neg | No | Neg | Neg | *Mycobacterium avium* enteritis; *Balantidium* sp. colitis |
| 32 | 52 | others[d] | Neg | No | Neg | Neg | No |
| 33 | 4 | others[d] | Neg | No | Neg | Neg | No |
| 37 | 0 | n/a | Neg | No | Neg | Neg | No |
| 38 | 0 | n/a | Neg | No | Neg | Neg | *Balantidium* sp colitis |
| 41 | 640 | others[d] | Pos | Yes | Pos | Pos | *Balantidium* sp. typhlocolitis |

[a]Number of adenovirus sequences detected at 64 weeks.
[b]Results from PCR for indicated adenovirus (primers, Supplemental Table 1).
[c]Results obtained at necropsy.
[d]Novel adenoviruses highly diverged from Adenovirus 1-5 as well known adenoviruses.

Example 5

SIV Infection and the Bacterial Microbiome

Figures 8A, 8B, 8C:
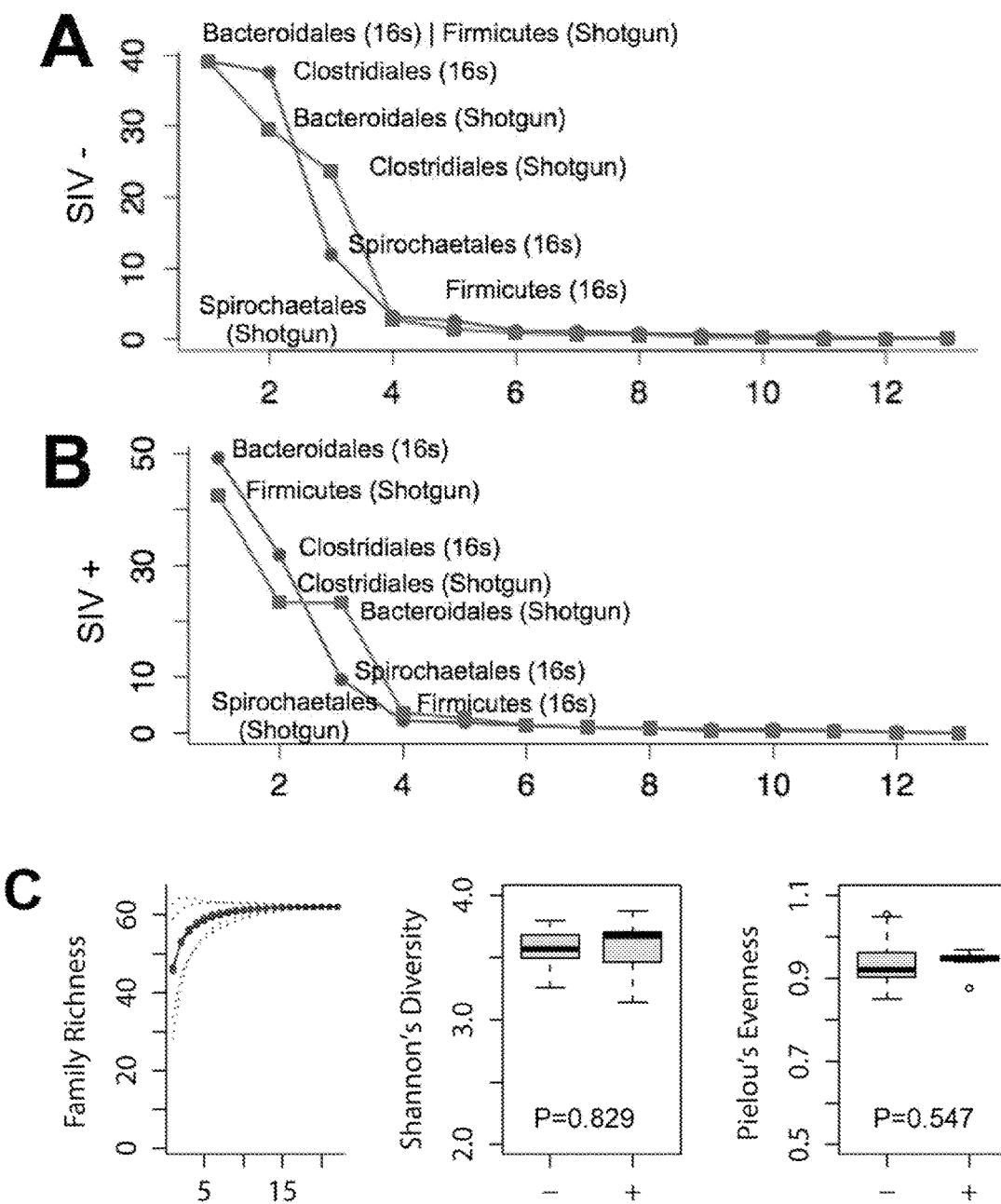
FIG. 8A is a rank abundance plot for SIV− animals constructed using both 16S rDNA sequencing from a previous study performed from TNPRC (McKenna et al., PLoS Pathog. 4: e20 (2008)) and our next-generation sequencing (NGS) data from TNPRC (Table 2.
FIG. 8B is a rank abundance plot for SIV+ animals constructed using both 16S rDNA sequencing from a previous study performed from TNPRC (McKenna et al., PLoS Pathog. 4: e20 (2008)) and our next-generation sequencing (NGS) data from TNPRC (Table 2.
FIG. 8C are graphs showing species accumulation (left panel), Shannon's diversity (middle panel), and Pielou's evenness (right panel) for SIV-infected and control monkeys housed at NEPRC for 24 weeks. The species accumulation curve was constructed for SIV-infected (red) and uninfected control (blue) rhesus monkeys by quantifying the average number of bacterial families identified as additional animals were added to the analysis. The corresponding Shannon's diversity and Pielou's evenness ranges were calculated for equivalent sample numbers based on the minimum sample number between SIV+ and SIV− animals. When this minimum number was less than the maximum number of animals, 100 random samples with replacement were used to determine the sample mean. Differences between means were assessed using an unpaired Student's t-test. The nature of SIV infection is as defined in FIGS. 1A-1D.
Figures 8D, 8E, 8F, 8G:
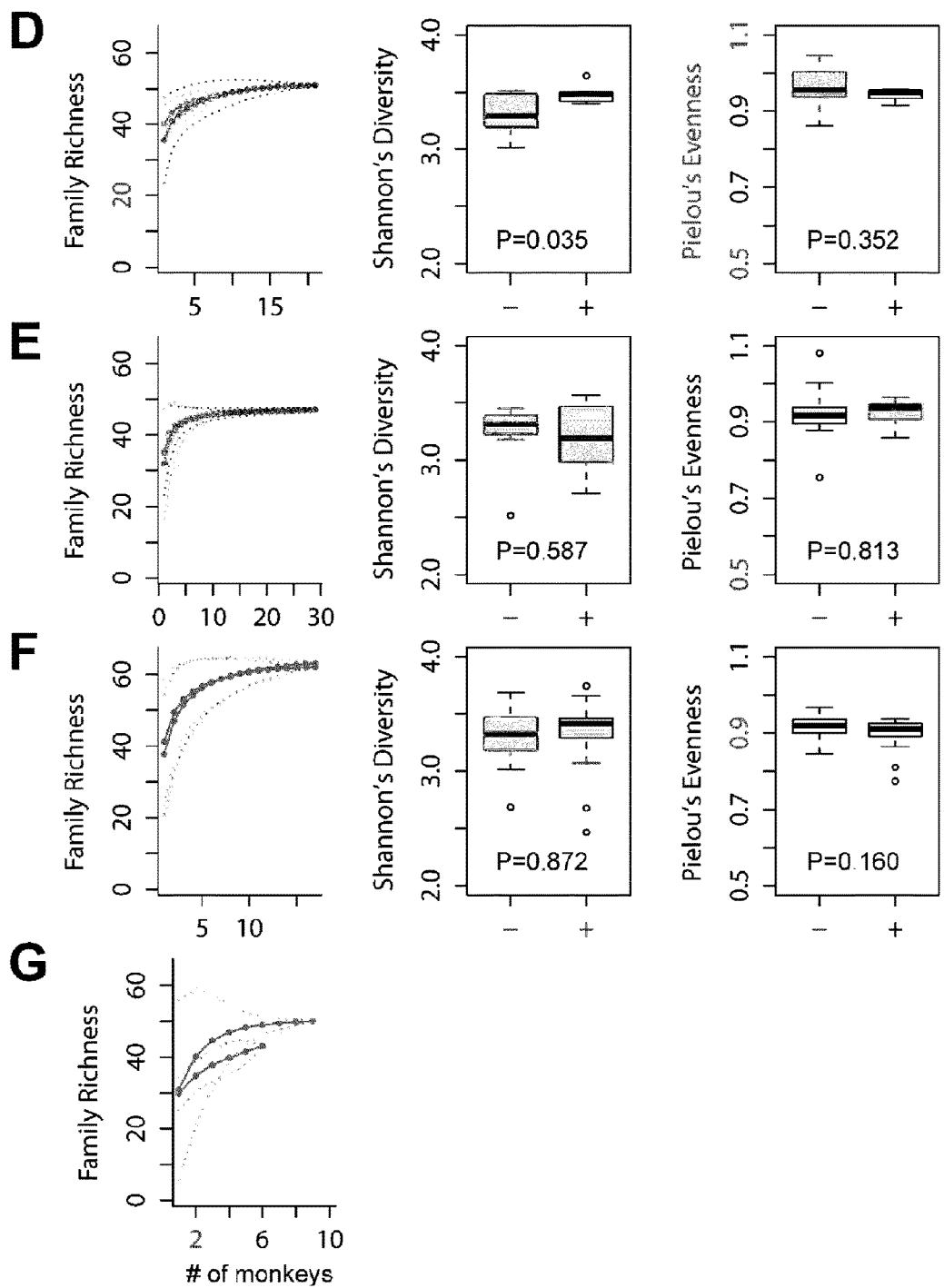
FIG. 8D are graphs showing species accumulation (left panel), Shannon's diversity (middle panel), and Pielou's evenness (right panel) for SIV-infected and control monkeys housed at NEPRC for 64 weeks. The species accumulation curve and corresponding Shannon's diversity and Pielou's evenness ranges were calculated as described for FIG. 8C. The nature of SIV infection is as defined in FIGS. 1A-1D.
FIG. 8E are graphs showing species accumulation (left panel), Shannon's diversity (middle panel), and Pielou's evenness (right panel) for SIV-infected and control monkeys housed at TNPRC 23-64 weeks after intravaginal infection with SIVmac251. The species accumulation curve and corresponding Shannon's diversity and Pielou's evenness ranges were calculated as described for FIG. 8C. The nature of SIV infection is as defined in FIGS. 1A-1D.
FIG. 8F are graphs showing species accumulation (left panel), Shannon's diversity (middle panel), and Pielou's evenness (right panel) for SIV-infected and control vervet African green monkeys housed at the NIH after intravenous infection with SIVagm90, SIVagmVer1, or after natural infection in the wild. The species accumulation curve and corresponding Shannon's diversity and Pielou's evenness ranges were calculated as described for FIG. 8C. The nature of SIV infection is as defined in FIGS. 1A-1D.
FIG. 8G is a graph showing species accumulation for SIV-infected and control sabaeus African green monkeys housed at NEPRC and infected intravenously with SIVagm-MJB or SIVagm9315BR. The species accumulation curve was calculated as described for FIG. 8C. Based on the lack of comparable family richness between SIV-infected and control animals in this cohort, we do not report diversity or evenness.

We next assessed the effects of SIV infection on the taxonomy of the bacterial microbiome. Our metagenomic data was comparable to published 16S rDNA-derived class-level data from SIV-infected and control macaques at TNPRC (McKenna et al., *PLoS.* 4: e20 (2008)), indicating that these distinct methods yield overall similar results (FIGS. 8A and 8B). Rarefaction analysis revealed that all but a few samples with very high numbers of viral sequences were robust for analysis of bacterial diversity at the family level (FIGS. 8C-8F). Species accumulation curves indicated that all cohorts except the NEPRC African green monkey cohort were robust for this analysis; further analysis excluded this cohort (FIG. 8G). We detected no consistent SIV-associated differences in bacterial family richness, evenness, or diversity (Legendre and Legendre. *Numerical Ecology, Second English Edition.* Amsterdam: Elsevier Science (1998)). There was a statistically significant difference in Shannon Diversity in the NEPRC cohort sampled 64 weeks post-infection between SIV infected and uninfected control monkeys (p=0.0345), but this was not replicated in either other cohort of monkey infected with pathogenic SIV (NEPRC cohort at 24 weeks of infection, TNPRC cohort, FIG. 8C). There were no significant differences between SIV-infected and uninfected monkeys in any cohort amongst the most-represented 20 bacterial families (FIGS. 9A-9D). There was no significant difference in bacterial family evenness across cohorts (FIG. 8C-8F). Additional analysis using principal component analysis and both supervised and unsupervised random forest analysis (Yatsuneko et al., Nature. 486: 222-227 (2012)) showed no association between SIV infection and the bacterial microbiome. Further we failed to find an association between SIV infection and either the genus- or species-level taxonomic structure of the bacterial microbiome. Thus, in contrast to our analysis of the virome, we detected no consistent SIV-infection associated differences in the family-level taxonomy of the bacterial microbiome.

Other Embodiments

While the invention has been described in connection with specific embodiments thereof, it will be understood that it is capable of further modifications and this application is intended to cover any variations, uses, or adaptations of the invention following, in general, the principles of the invention and including such departures from the present disclosure that come within known or customary practice within the art to which the invention pertains and may be applied to the essential features hereinbefore set forth.

All publications and patent applications mentioned in this specification are herein incorporated by reference to the same extent as if each independent publication or patent application was specifically and individually indicated as being incorporated by reference in their entirety.

SEQUENCE LISTING (371 sequences)

SEQ ID NO: 1 - DNA, 8817 bp, WUHARV Adenovirus 1 contig00001
gagggggggccggggtgacgtgcggtgacgcggggtgacgcggggtggcgcgagggcgggtgtgggaatagtgaaaaaaggcgcgcggaagtgacgttgtgagactgaaattgcggaagtgctgacggcgctggattttcgcgggttttgtgggtgtgggtgaactttggtcgtgggtggtacggtgttagcgtcattgggcggagtgtatatatagctataggctgttgggtggattttagctcgactttttcgtggctttatacgcggtaagacggggcaatggctgatcaacacatatatgtgcatttgctgggacgtcgggcctttttgccccagcaacagggttattctaatatgtatgttcttttttcaccggaggattttgtgcttgctcccagagggattattttgctgtctttgcagctgtcgttggatattcccactgggtatctgggacgttttttttctgtggcggatatgaatgtgaggggggtattgctgtgtgctcaggagatccaaccgagtacatggtgggaagtttctgttgttctttttaatcattcggatgaattttaccgcggttcccggggacagccggttgcttgcctgctgctggagcgtgtcatatatcccaccgttcgccaagcttctttagtttaatgtttatttttattttaggtcaacatgtatctgagccgccctattttttttgctgtgcatattcccgcacagttgcttcagtacttgcacggactgaatatagaagtactggactttttaaaggagcagcttagtgatttttggctgaacattttacactgtgttactcccattcatcagttttgctactcgggagcggttctagtgagtttggcgccatccctggaacttttgtgctgcatagccacacctgatttagttcctagcgcggagttaacagatttagtcggcgcagatctatttaattatttgcaaatgaccttgcggatggagattcgcgatcgcggagagcaacctgacctgggtctgttaaatctgctgcaggtgtctcaggagcccgatatcttgcagtcatgatggtgtgtctacgcatggctatagagggcgccctttcggagctttttaatatgcacggcatgaaccttcagactatttgccgcgacatcattcgcgagtggagaaatgaaaattacttgggcattgtacagtcctgcagcttgatgatcgaagagtttgataataacgcttttgctttgctggtgtttgtggaagtgcgggtccaggctcttttggaggccgcgattgatagcctggaaaatcgcataatgtttgatctggctgttaaattccatcagggctccggaggcgaccgttgtcatcttcgggatcttcatttcgacccgttggtgaatcgcttggaataacatgcctcttccgtgtcttcctccacctccagtgtgtcgggatagatcaggctgtctgtcttggttggaactcgccctcactacgtgtttggaactgtaccgagacatctgtaggtttgaggtgtgcatcgccccggaggccgagagggatctgtgtggattacaagagtggttgcactttgcgttgaggagggagcgtgagcgacgcagggaccggcgttacttggagacgtgctggcagcggacgtggttctgctactacaagtacgaggaagtgcgtcggtccctggtctacgatgcaacgcgacagacggtatcgctgcagactggctccctacaattgtcaccagctaccaccttgtgaggaccgcggcagtgctgttgtagaggagagctctcggtacttagaatgtgaaaatatgaacatgcacaatgttagtgaggtgaggagtataccatcttgtattagctttattgtactgcaggagtggcccgtgtattgggattgtattttaacggcctgggaaaaacatgtgatgaaaatgtatatgaaagtgtgtatctgctgtgccacgttagatctggatttccatcagaccattaggggttatgagagatggattattcactgtcattgtaactctcccggttctcttcagtgtagagctggtggggcggtgttagctaattggtttaagatggctatctatggctccctgataaatgtgaggtttccctggtacaggcaggtggtgaacaggggactgccccgggaggttctgtatgcgggtagcatgtttgtacgcggcagacacctgatttatgttaaagtaaggttggacggacacgcggtggcgctgttggagcgaatgagctttggctggagcgtgttcagctatgggatcatgaacaacctgattgtgatggtgtgcgattcttgccggaatctcagtgagattcagatgcgctgctgcgccagacgcactcgtagactgatgatccatgctgtgaggctgctggacaatctaacttcttaccagcctcacaggagtcgcaccgagaggttcagacagcgccacctgcgtggtttagtggaacatcatcgcacctttaccctgtctgagtttgatcggggagataacccgtggagagcctgaacctgtttgttttgtagggcggcatgcagtttttcaccgaaacgttggagaacctgccccagggatttgtgtccatcacggatcgacatctgattaccaaagagactgtttggatcttaactcccaaataccggactggctcgcagcagtttactgccatgaagggggagaggctggtgtatgctgtcaaatggaagggtggaggaagccttactgtgcgtgtaaaataaaaagaaaataaaaaggaaaagttgttttattcttccgtaatgtaagagaaaaaacagcatgggatgtcaaatggttgtcttgaaacagttctccaaataaatttaaaggagtagccagttggtccatagttgtactgtatttggtacggtacgggcatagaaaggtcaccctgtatacaagtgtagcccacagtttgattctgaacttcgcttccacgccctcttgggtacctttttgaactgggcataaatgctagtgcattgagtacattagtgtctgcagattctccctgcctataaccccaagttgcattatttcccaacgtgccttgagtgcccaaagtgggataattgagaattcgcactccataattgtcaaaatgtagtataataacaatggcactttccgtaggactcaatagggttcctttcaatgcttttaaagcaacagaaccgtgaaccacacccccttgttttaccaacgagagccacattttggcatctaaatcagtgtagatggaacaattgggggatggatcggcagtggtccataaggtgtcaggcgatgtaacttgaggagaaacagctatgtttccattgccatcaaaacctaatccatttcctagctttacaatgaggtagtcattttcccaggttaaacccttgttttgattggggttcacgtccaattttttactcactggattgtaacgcagcccagcgcccacgttaaggcgaagctgatcagtgtattgtaaaggcaaagcagcactaagagcgacagaaacggtgttgttgtcaaagcgaagatccttaccaagatttaaaattaaaccatcgtaactcactgtgaggccgcggcctgtgttaacagtgagcgcctcatcgcgcactgcaagaggggtgtaaaagttaagccctagtacggggtcgctgttgaaaagacgcaggggagctctgaagtccaaaaacaagttgttgtcctgaacaataagtgggcgctttatggctaagcctagggtcccgttgcttacagttaatggcacgttggtttgcaaagtcaagcctgtgtctgctgtttgtagcggtggggagagctgtagagccagctttccactattggtaatggcaaggggtcgttcaatggctaacgtgagaaagttattctgcaagtacaaagggttggtaaacaggagttttagggtttggtctgcaatgcctaaaggggcggcgctttgtaagcgaagggtgccagcgttagttacaaggggcgcggctgtttgcagggctagtttgtccttgtcatttataaaaataggctctgaaacttgcaatgctaaagagttatcagcaataacaaggggagcggtgtgcgataaggttaggctgttgcgctttactgctaaaggatcgctatagaccagtgcaagtttgttgttagcgttagtgagtggaggttctacttccccagcggttgatgttagttgtccctggttgtctagagtgaggccgtttcctagtttaactgtaagagacccattttgcgtagtaatgggatctctgtagtttaaacttaacactccaagtggtttttcctgcaacccatccgaggaggtaaaaggtggagtaatgaagggcataacgggagcatgtggggggtcataagggtacactgggttgaagtcttcatcaactctcgcccgtttcatctgaaaaaaacgaaacggtggggtacacggttttattgttctgtaatgtagcaaaacgaagttgttggggttgcaaacttttcacgtgcaagagcagtccacttaaaagataaggaatatcctgtggcggctgagttgtaggttacagtaagaatgattggtttttgaacatttcccctaagatacgtttggacgtagtagttgtttcgtggttcaccacctccccctcttgcatatatggtactgttaggcataaacgccagggcgttgtaggtagggtttgaggccgtactgtcattctgtcgaatactaaaggcgttgtttataagcggagagcttagtagcttaccattgttgtcaaatgtaaattgaatggtgacagaaatatcagtcatttgggttatggttcctgttaaaccggttaaacttacacttcctaagacgtgagctccgcatttggttaaacagagactaagtagggaatcgccctcgctgtagacggtgcagttgccagtcgaggtcggagcggtccacagggtttgtatgccaaaagctatggatccgttgctgtcaaactttaagtctgaactcaggtttacagctagtgagcctccgacgctactaaggccttttgaggaattgatgtcaatggcaaggctgttatttataagtttaagaggctctgtatagttaaaagtaaggttttcattttcataacggagtggtgatgtgaagttaaatgtaagtttgttgtctgtgacgcggagcggactcgagtagcctagcactaagctattgtcagttaggtttaaggggggagaatgacgtagggtcagtgtgttgttgttggtaattatcaacggtgggttggtttgtacgctctgcgtactttctaattgtccggcggcggtaattgtcaaccctcttccaagtgaaagggctagttttctctccatgtcgaaatataggggtttagctattcgcagacttaaaacacctggggggttttcctgaagaccatcgctgtttacaaaggggggtgatataaagggaactgcaggagtggttgtggtgtcataggggtagacggggttgaagtcttcatcaactctggttcttttcatctatgaaaagatgaaaattgtgggtgaggacaaggaagtggataccaatatttcttttagggtttggaggaagtttgccacccactatcgcatcccatacgagagctgggaagagggtaaagtggtgctgctgaatgatgtcaccagaaaattgttgtcaaatttaaggtaagtttattatgatttacattttaaaaatatcacctaaagcacagagagttttgattagtttggacatgcaatcaggtgcgtgacagtgacagaggatagccccctctacaggcccggcttgttgggtgattgtgatggaggtagagcccatcatggtgcagaaggtttgtttctgcaaaggcaaagtgtaagacagttcatgtccctgaacgctgacatcgtaggaaagggctgcctgcttaacatgacacagcactcctttctcacaccagtgggactccttaagctgttgtagttccaggtattccaacactcgcgtttctcgctgacgctgagcagctattctttccacactaatattaatgtcctgagagtcagtcatctccaccggtgagttgaaagtagctcacaatagagggagctcgaggaagaagatcaggaggaggcagaggctgtaattgaaaagcgtttacaagaggatgtctaggtaaatcttctctgggatgtagccacccagtgtgtagaataaaatacaattttactccaaggcaagtagatacaaataccaaagcggcggtggctgcgtaaagccaagcaacaggagtgtcggggattttatcataacaggtgtagaatgaccagggtttggtgaatggacaattacagttgattaggggtaaataattaagtattagcaatagcttaatcatgccaaacaaagtaaggaggcaacgttttgatttctgtattcaggatggtgtctaaagtaagcaattcgcacgtaaagatagtcggcggcttgaaagattgttataaaaaagcaggctatactgcaaatggatatacaacaaacaaaggtgagaatcagatacacgtcaaaaggcggtaggcactctggttccaggtgggaaactgcggcgaaagttgaagagacgaaaatgatgggtagacagaggagaagtagaaatgcagctaccatgctggaaaacaaaatcacacttgttgaatgacaggttttagtttaagtttttcaaacttaggttttttgggcttgcaaaagcagtaaaatgctaggctgacaataatggtaattaagctcacaacaatggcagcaatgaaaattggagtaaaatcagttccagtttcgagcgcttgtatttcattgcaaaggtcgttaaacgggtatgagaaattgtaaggccgcttggcatacgtttctctgtaggtggaaaattcaacaacagcagtaaaataatcaggtaactgtttaccgttaccagcgcttgttgttaaataataaaaaagattactttcctgtccattatagtaaattctagctggatatttagagttgctgcagttaatgtgtatgaggcagtaggcatccacgccttgaacttcaaggtaagaggaggaaacctcacattttggaggtgtcaggtccacaaccatcaattcaatgtaatcactgtggacttctaaattacttttttcaactacagcatgatacaagccagaatctgaaggctttaagttgtaaagcttcaagcttttgtttacgcattcgaattgtagtgaagggtggggaaatgtgtgcgtcctgttgtcggagtcatcgcagagtttgtttccttcataaaatgaagaattaggtttggaggtttgtaagtaccacgtaatatggggtatctggtcggaatctggcatgtaagcagattgaagagttgcattgtaacctgcgccaacaatacttgttctggcgtgagagagagcgaaaaatgtggcgagcaggaggataacaagcatgtttactgtaagttgttaattattataaagttaataaagattatcagtatcaaagctaaaataccaattagaggtttgaaagagtaaccagagggagaacagcagtaggacagggtgaaaaaagaaacagaattgttgggaagggtctctttttgtagaaaccacttatgaaagcaactaggatttaaaccggagccaacgcacatataccatccagtaacaaatgggggataaaggattagtgtggaggagttgcagtgcttgcaaaggctgttatttctactaactatctcgttcccccaaaagtacttgcacacactaccgtttgcaatccactggataagttcgttagtgcaggcgcagttcagcacaatagatgaggtagaattagaataaaatacagtttgtgtacctttgccagaagaactttttgttgtagaaatcacagatggcgttgaaggtgcggcaaacagttcagtttttattaaactgagcgcaaagatgacaacacagatcttcatgtaatccgggcgtggggcagatgcagaacagggtgatggtagtgatcccgcgttcggtttctaccaggagaggccgggcggtgaaggcgtcgatgaggcgagactcgagcgcgttctcgatctcgagtttcaacccgtgagccggcccctgagggtgctcgtccggcagctcaaagtagctgaacacgatcgcctcccgagcgtagcagcgaggctggcggcagtgatgcagatgtcgcagccgagctctcacggccgcaccatctgtcatcagtcgtagccgtccacggattcactcactgcgtcaaagttgggaatgaaggcgtccgggtagcgtccaggtgagccggaaaacgggttgaagtagacggaggggacgaactcttccacgaactggagagtgccgattcccccggagcgcggctgcgaggaagagctctgcagggtcaggtaggcctggcgagtggtgaaggaagagcggcccgctcctccgagctggaagactccgtcaggtctgagaccggttgaggagctcaccgcctcgtcgttgagctggatacctcggcctcgaatgatcaccctctttatactcccggagagtaaggagcggcccgacctctgtacctggcgtacctggacccgcccgctaattgtaccccagagttggtcatg

SEQ ID NO: 2 - DNA, 5759 bp, WUHARV Adenovirus 1 contig00004
ggggcggggcgaggttcgcaggcgggcgtggggaggcgcttagcttttacgtatgcggaaggaggttttatgccggaagttgggtaatttgggcgtatacttgtaagttttgtgtaaattggcgcgaaaactgggtaatgaggaagttgaggttaatatgtactttttatgactgggcggaatttctgctgatcagcagtgaactttgggcgctgacggggaggtttcgctacgtggcagtaccacgagaaggctcaaaggtcccatttattgtactcctcagcgttttcgctgggtatttaaacgctgtcagatcatcaagaggccactcttgagtgccggcgagtagagttttctcctccgcgctgccgcgatgaggctggtccccgagatgtacggtgttttctgcagcgagacggtccggaactcagatgagctgcttaatacagatctgctggatgttcccaactcgcctgtggcttcgcctccgtcgcttcatgatcttttcgatgtggaagtggatccaccgcaagatcccaacgaggacgcggtaaacagtatgttccctgaatgtctgtttgaggcggctgaggagggttctcacagcagtgaagagagcagacggggagatgaactggacttgaaatgctacgaggaatgtctgccttctagcgattctgaaacggaacagacagggggagactgctgtactgagccggtagtgaaaaatgaacttgtattagactgtcctgatcaacctggtcatggctgccgtgcctgtgcttttcatagaaatgccagcggaaatcctgaaactttatgtgctctgtgttacctgcgtcttaccagcgattttgtatacagtaagtaggagctttttcgatttgcgcatggtggtgggattgttaaagtgtgttgggcttattgtttgtgtaatgttttacaggtgacgtgtctgacacggaaggggacggagatagattagggtctgctaattctccttgcactttgggggctgtggttccagttggcattattaaacccgtggcggtcagagtctcaggcagacggtatgcagttgaaaaattggaagacttgctgcaggaagaacagacggaacctttggacctatccatgaaacgccctaagctgacctaagtgtgtttattgtatgcaataaaagtgttgatctttgaactgtgtttatgtgttgggtgtgtctgtgggtatataagcaggtgaatgggaagtgagagcacagctgccttaatggatctcttggggaacttgagggaatttgacgtggttcgccgcttgctggagttggcctctgacaaaacttccaggctttggaggttttggtttggctcaacgcttagcagcgtagtttatagagtaaaaagagagcaggaggcgcagtttgctaggctgttggccgagactcctggagttcttgtggctctggatctaggccatcactctctttttcaagaaaaaatcatcagaaacttaactttttcgtctcctggccgcacggttgcttccgcagcctttgttgcctatattttggatcaatggagcaacagcaacagccacctgtcgtgggagtacatgctggattacatggcgatggctctgtggagggccatgctgcggaggagggtttgcatttacttgcgggcgcagcctccgcggctggaccgagtggtggaggagaacgagccggaggagaccgagaatctgagagccggcctggaccctccagtggaagactaggtgctgaggatgatcctgaagaggggactagtgggggtgctaggaaaaagcaaaaaactgagcctgaacctagaaactttttgaatgagttgactgtaagcctaatgaatcggcagcgtcctgagacggtgttttgggctgagttggaggatgagttcaagaagggggaattaaacctcttgtacaagtatgggtttgagcagttgaaaactcactggttggagccgtgggaggatatggaaatggctctagacacctttgctaaagtggctctgcggccggataaagtttacactattcgccgcactgttaatataaaaaagagtgtttatgttatcggccatggagctctggtgcaggtgcagaccccagaccgggtggctttcaattgcggtatgcagagtttgggccccggggtgataggtttgaatggagttacatttcaaaatgtcaggtttactggtgatgattttaatggctctgtgtttgtgactagcacccagctaaccctccacggtgtttacttttttaactttaacaatacatgtgtggagtcatggggtagggtgtctctgaggggctgcagttttcatggttgctggaaagcggtggtgggaagaattaaaagtgtcatgtctgtgaagaaatgcatatttgaacgctgtgtgatagctctagcagtagaggggtacggacggatcaggaataacgccgcatctgagaatggatgttttcttttgctgaaaggtacggccagcgttaagcataatatgatttgcggcagcggcctgtgcccctcgcagctcttaacttgcgcagatggaaactgtcacaccttgcgcaccgtgcacatagtgtcccactcgcgccgcacctggccaacatttgagcacaatatgctcatgcgttgcgccgttcacctaggtgctagacgcggcgtgtttatgccttatcaatgtaactttagtcatactaagattttgctggaaactgattccttccctcgagtatgtttcaatggggtgtttgacatgtcaatggaactttttaaagtgataagatatgatgaaaccaagtctcgttgtcgctcatgtgaatgcggagctaatcatttgaggttgtatcctgtaaccctgaacgtcaccgaggagctgaggacggaccaccacatgctgtcttgcctgcgtaccgactatgaatccagtgatgaggagtgaggtgaggggcggagccacaaagggtataaaggggcatgaagggtggacgcggtgtttcaaaatgagcgggacgacggacggcaatgcgtttgaggggggagtgttcagcccatatctgacatctcgtcttccttcctgggcaggagtgcgtcagaatgtagtgggctccaccgtggacggacggccggtcgcccctgcaaattccgccaccctcacctatgccaccgtgggatcatcgttggacactgccgcggcagctgccgcttctgctgccgcttctactgctcgcggcatggcggctgattttggactatataaccaactggccactgcagctgtggcgtctcggtctctggttcaagaagatgccctgaatgtgatcttgactcgcctggagatcatgtcacgtcgcctggacgaactggctgcgcagatatcccaagctaaccccgataccgcttcagaatcttaaataaagacaaacaaatttgttgaaaagtaaaatggctttatttgttttttttggctcggtaggctcgggtccacctgtctcggtcgttaaggactttgtgtatgttttccaaaacacggtacagatgggcttggatgttcaagtacatgggcatgaggccatcccgggggtggagataggaccactgaagagcgtcatgctccggggtggtgttgtaaatcacccagtcgtagcagggtttctgagcgtggaactggaagatgtcctttaggagcaggctgatggccaagggcagccccttagtgtaggtgttaacaaagcggttaagctgggagggatgcatgcggggggagatgatatgcattttggcttgaattttgaggttagctatgttaccacctaggtccctgcgggggttcatgttatgaaggaccaccagcacggtgtagccggtgcacttggggaacttgtcatgcagtttggaggggaaggcgtggaagaatttagagacccccttgtgaccccctaggttttccatgcactcatccataatgatggcaatgggacccctggcggccgctttggcaaacacgttttgggggttggaaacatcatagttttgctctagagtgagctcatcataggccatcttaacaaagcggggtaggagggtgcccgactggggaatgatagttccatctggacctggggcgtagttgccctcacaaatttgcatctcccaggctttaatttccgagggggggatcatgtcaacctggggggcgataaagaacacggtttctggcgggggattgatgagctgggtggagagcaagttacgcaacagctgggatttgccgcaacctgtgggaccgtagatgaccccgatgacgggttgcagctggtagttcagagaggaacagctgccgtcggggcgcaggaggggggctacatcgttcatcatgcttctgacatgtttattttcactcactaagttttgcaagagcctctccccacccagggataagagttcttccaggctgttgaagtgtttcagcggtttcaggccgtcggccatgggcatcttttcaagcgactgacgaagcaagtacagtcggtcccagagctcggtgacgtgctctatggaatctcgatccagcagacttcttggttgcgggggttgggccgactttcgctgtagggcaccagccggtgggcgtccagggccgcgagggttctgtccttccagggtctcagcgttcgggtgagggtggtctcggtgacggtgaagggatgagccccgggctgggcgcttgcgagggtgcgcttcaggctcatcctgctggtgctgaagcgggcgtcgtctccctgtgagtcggccagatagcaacgaagcatgaggtcgtagctgagggactcggccgcgtgtcccttggcgcgcagctttcccttggaaacgtgctgacatttggtgcagtgcagacacttgagggcgtagagtttgggggccaggaagaccgactcgggcgagtaggcgtcggctccgcactgagcgcagacggtctcgcactccaccagccacgtgagctcgggtttagcgggatcaaaaaccaagttgcctccattttttttgatgcgtttcttaccttgcgtctccatgagtctgtgtcccgcttccgtgacaaaaaggctgtcggtgtccccgtagaccgacttgagggggcgatcttccaaaggtgttccgaggtcttccgcgtacaggaactgggaccactccgagacaaaggctcgggtccaggctaacacgaaggaggcgatctgcgaggggtatctgtcgttttcaatgagggggtccaccttttccagggtgtgcagacacaggtcgtcctcctccgcgtccacgaaggtgattggcttgtaagtgtaggtcacgtgacccgcacccccccaaggggtataaaagggggcgtgcccactctccccgtcactttcttccgcatcgctgtggaccagagccagctgttcgggtgagtatgccctctcaaaagccggcatgatctcggcgctcaagttgtcagtttctacaaacgaggtggatttgatatttacgtgccccgcggcgatgcttttgatggtggaggggtccatctgatcagaaaacacgatctttttattgtcaagtttggtggcgaaagacccgtagagggcgttggaaagcaacttggcgatggagcgcagggtctgatttttctcccgatcggccctctccttggcggcgatgttcagttgcacgt

SEQ ID NO: 3 - DNA, 2968 bp, WUHARV Adenovirus 1 contig00010
cgctgccggtggcggcggaaataggcagagtgtttccccagaaagcgatacaggtgttcctggttacggcgcagggtgggggcgacctgggggctgtgaagcatgctgttgggcactccggtgagcagatccatggtggggttgcgctccatggggttgtgaggccagtgcacgaaggcgtgcaaaaacatgcaacagaaaagcccgcaggcggccgagaggggcccctggaccgtctgggtggacttttccagggtgacgcagtggtcgggcgtggaggccagagcgctgcgcttgaggagcccctcgtactcgaattggtagatctgcttcagcctttcgtcggagaaaccaaaagggtcgaacaggtagcaggtgcggttacgcgggttccaggcgaaggcgagccagtgcacccccccggtctcccgtccggccgtgttaacgatggcgcaggccggcttgtggggggacataaagccggggaaccgcttgtcgaaggtgcccaaaaagtagggcccgcagcccaggtcgcgaacaatggcctgcagctcctgttcgctggagcccattggcttctttaggtggtggcgttaccggcagagaaaggtgtgcgcaggtagacggcctcgatgacgccgcggtgcggctggtggatgcgcaccacgtcgaagacttcaaacaaaacatagagaagcgtgggctcatccatgggatccacctcaaaggtcatatccaaggcgtgagcggagttggcgtacagcatgttctgccccaggtcggtgagggagcccatagacatgaagttgctagagaagggtatcctccacatcacccggtcacagaggaactttttctgcgtcaggctgggtacggcggtggccccgatcaggggatagggataattggccgggtaggcctgcccctctcgcatggtgggacccatgtaccccacaaagccggagttattgtgctggaatggcatttttacttccttgtagttagcatagttaaccgagtctaccacctgccgactcataggttggaagtttctgaagaaggagtacatgcggtccttgtagttttcgggcacgtagaagccctggtagccgatgttgtagtggctgagcatctgaatcaggaaccagtccttggtcatgttgctttgggccacgttgtacccttcaccgtccaccgaacgcttaatttcgaactcgttgggcgttagcaggcggtcgttgccgggccagctgaccgatgagtcaaacatgatggacacctttttaaaagtgtggttgaggtaaaaggtgccgtccaggtagggaatggagccggagtagacaaagtatgggtcaaaaccggagcccagcgagggagtttccttggttttaaggcgggtaaaactccagcccctaaaagctgcccagttgcgagagggaatagagatgggcacgctggtggcgttcgcggggatggggtacagcatgttagctgcgcacaggtagtcgttgaaggactggtcgttggtgtcgttgcgcagcatggcctccagggtggaagccgtgttgtgggccatggggaaaaaatttgcgtagaggttaatgctgtcgaatctaacgctagccccgtcgacacgcaggtcgttgcccagagtgctctgcaagatcatgttcacatcttttctgaagttccattcgtaggtgtaagacccaggcagtaaaagcagattcttaatagcaaaaaatttctggggcacctgaatgtggaagggtacgtaccgaccgttacctaggagcatagagcgatagcgcagaccggcgttgcggtggtgattaaaagggttaacgttgtccatgggatcgggagaccaacgggcgccaatattgacatatgtatcaatagcgttgggggcagtaaccctgccgttaatgtagccgtagctgttttggtttgttggaagttcaatgttgtcaggggtgtacttgtaggagtctggcaagtacagggcaacattggagtatagaaaactgcgccacaaattagctgccaaatttatttccatcgcaaaaatgttgccgatggaaatttcattgttttcggcagcgttgttgttagcctgccatgtgttttgtccattttgtacagacagccccctgtaggtgtttgaaattccctgtccatttagtggaaaacaataatttggaagctcgtcttcaacgccgtggttttcaattatcctaacatctggatcgtaactgtcaacagcttgattccacattgaaaagtatcgacttctgtctcccaatgcgtcgagcataagctggtatgacaattcggtgtttctgtcttgcaagtccacaactgcatttaactgagacgcttgacctgccaacactcccatatttccagttgagttgtaatacattagaccgataaagttatctctgaatccaatgtaattgggtctgttgggagcggactgctgccctagaagggtttctgcagcttttgcattatctgcaacgtcgggtttaaaaaccaagtgggtgtcaggcgcttccaaattaacgtcttcgctgtacagtacaaccttagcttgattctggttatcggcggtggttgtgaaaaactccatgctgacgctgtttgcgccagtggggtccgttgagccatcggtaatttttacttgaccgccgttttcattagtagggtaagcgtaggaaccgtagcaaggttgcattggggttgttggttttagaattcttcccgcggcattttgcgtgggattaatgttccattgtgatgttccaacttgaggctctggctggtaaatcttattcgcgtacaccgcggcgttggcattgtttgtgtctactgccacttggatgccgtttgttgttaggtttgcccccatacctatgtacgacgcttgagcaaaagaattggtttttgctgttcccccgttcgc

SEQ ID NO: 4 - DNA, 1701 bp, WUHARV Adenovirus 1 contig00033
gggggtcggcgtcgatggtaaatatgccgggtagcagaattttattaaaataatcgatttcggtgtccgtgtcttgcaacgcgtcttcccacttcttcaccgccagggccctttcgtagggattcaggggcggtccccagggcatggggtgggtcagggccgaggcgtacatgccgcagatgtcgtacacgtacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggccccggacagtcccacggagtcttggatgaattgggcgtaggattcccggagcttgtccaccagggctgcggttaccagcacgtcgagagcgcagtagtccaacgtctcgcggaccaggttgtaggccgtctcttgttttttctcccacagttcgcggttgaggaggtattcctcgcggtctttccagtactcttcggcgggaaatcctttttcgtccgctcggtaagaacctaacatgtaaaattcgttcacggctttgtatggacaacagcctttttctaccggcagggcgtacgcttgagcggcctttctgagagaggtgtgggtgagggcgaaggtgtcccgcaccatcactttcaggtactgatgtttgaagtccgtgtcgtcgcaggcgccctgttcccacagcgtgaagtcggtgcgctttttctgcctgggattggggagggcgaatgtgacgtcgttaaagaggattttcccggcgcggggcatgaagttgcgagagatcctgaagggtccgggcacgtccgagcggttgttgatgacttgcgccgccaggacgatctcgtcgaagccgttgatgttgtggcccacgatgtaaagttcgataaagcgcggctgtcccttgagggccggcgcttttttcaactcctcgtaggtgagacagtccggcgaggagagacccagctccgcccgggcccagtcggagagctgagggttagccgcgaggaaagagctccacaggtcaagggctagcagagtttgcaagcggtcgcggaactcgcgaaactttttccccacggccattttctccggcgtcaccacgtagaaagtgcaggggcggtcgttccagacgtcccatcggagctctagggccagctcgcaggcttgacgaacgagggtctcctcgcccgagacgtgcatgaccagcatgaagggtaccaactgtttcccgaacgagcccatccatgtgtaggtttctacgtcgtaggtgacaaagagccgctgggtgcgcgcgtgggagccgatcgggaagaagctgatctcctgccaccagttggaggaatgggtgttgatgtggtgaaagtagaagtcccgccggcgcacagagcattcgtgctgatgtttgtaaagcgaccgcagtagtcgcagcgctgcacgctctgtatctcctgaatgagatgcgcttttcgcccgcgcaccagaaaccggagggggaagttgagacgggggcttggtggggcggcatccccttcgccttggcggtgggagtctgcgtctgcgccctccttatctgg

SEQ ID NO: 5 - DNA, 1337 bp, WUHARV Adenovirus 1 contig00047
cgtccgtggtggtgagtatggtccatgatctcactcccttttcgggatccccgtagttgtaagccagaaaccagctccgatattcggtgtccatagtgccggtaataatgttataacttcgttttttactatcttcggtcaagggttttatgaccagcgcatgaggttccgtggcaaaggtgtcgccccgaatctcccgtccttgggcttccgcctttttcacgctgtcctcataagcaggaacgtctaacagccctggaatgttgcctccctccaggtcctcatacatgatctgaaagccctcctggaagggacggcgcttcctgattcctaacaggttactcaagcggctctgagtgaaatccacgccgcaccccggcagcagcacgatgtcggggtgaaaagcctcgttggtgtacacgcctggcattaccagcttggtcacgggatcccaccccagtcggaagtttctggtatcaaatttcacaccgatatcgctttccaataccccgttctgcctccccacttgcaggtaattgtccacgatcgcattgttcatcagatcgatagtcatagtctcggaatagttgccctcggggatggtgaactcaaaccattcgtactcgggaggctggttttctacctttttaaccatcagcctggccctgaacttgttggtggacatgaactcgttgatgttgggcatgttggtgtgcagaatggttttcagctgaccgccccagcgggaacgctcgtcaaagttaatggtctgcgtgcccgcctccgtcggggtgaagtcattgttctgcaccacggtagtcagaaagttactgtgatcgttttggtaattcagggaggcgatgtccgccgacttgttgtccaccaggtacaccttggtggtatcgtacaggggtgccagctcggagtaacggatgctgtttctgccctccgtaggtcccaggtatctgggaggaacgtaaggcgcctccagcgtggccggcacgttcgctgatcccatcacgctttcgtaagaagggggcggaccctcatacgccgccggcgtgactctcaccgctcttctcattctgccgcgccgaggaagaaagagaggaagaaagcacacacgctgtggccatggctctggtaagtttccgcttcttttttattagtagaggcgactcgaacgccccttgggttgcaagtgagcaaaggggttggctccgctccctcccaggtccaacacgctactatcgtctgcggagtcgtccgggtcttctctctgacgacgccagtgcggcggaaccagcggtcgcggctgactgtcctcccactcccgc

SEQ ID NO: 6 - DNA, 1049 bp, WUHARV Adenovirus 1 contig00073
aggaagagatgtgggacagccaggcagaggaggtgtcagaggacgaggaggagatggaaagctgggacagcctagacgaggaggaggacgagctttcagaggaagaggcgaccgaagaaaaaccacctgcatccagcgcgccttctctgagccgacagccgaagccccggcccccgacgcccccggccggctcactcaaagccagccgtaggtgggacgccaccggatctccagcggcagcggcagcgggtaaggccaaacgcgagcggcgggggtattgctcatggcgggcccacaaaagcagtatcgtgaactgcttgcaacactgcgggggaaacatctcctttgcccgacgctacctcctcttccatcacggtgtggccttccctcgcaacgttctctattattaccgtcatctctacagcccctacgaaactctcggagaaaaaagctaaggcctcctctgccgcgaggaaaaactccgccgccgctgccgccgccaaggatccgccggccaccgaggagctgagaaagcgcatctttcccactctgttgctatctttcagcaaagccgcgggcagcaccctcagcgcgaactgaaaataaaaaaccgctccttccgctcactcacccgcagctgtctgtaccacaagagagaagaccagctgcagcgcaccctggacgacgccgaagcactgttcagcaaatactgctcagcgtctcttaaagactaaaagacccgcgctttttccccctcgggcgccaaaaacccacgtcattgccagcatgagcaaggagattcccaccccttacatgtggagctatcagccccagatgggcctggccgcgggggccgcccaggactactccagcaagatgaactggctcagcgccggcccccacatgatctcacgagttaacggcatccgagcccaccgaaaccagatcctcttagaacaggcggcaatcaccgccacaccccggcgccaactcaacccgcccagttggcccgccgcccaggtgtatcaggaaactccccgcccgaccac

SEQ ID NO: 7 - DNA, 986 bp, WUHARV Adenovirus 1 contig00081
gcatcgatggcgctgaccacccgcaaccccgaggcttttagacagcaaccccaggccaaccgtttttcggccatcttggaagcggtggtaccgtcgcgcaccaacccgacgcacgagaaagtcctgactatcgtaaacgccctggtagacagcaaggccatccgccgcgacgaggcgggcttgatttacaacgctctgctggaacgggtggcgcgctacaacagcactaacgttcagaccaatctggatcgtctcaccaccgacgtgaaggaggcgctggctcagaaggagcgctttctgagggacagcaatctgggctctctggtggcactcaacgccttcctgagcacgcagccggccaacgtgccccgcgggcaggaggactacgtgagctttatcagcgctctgaggctgctggtgtccgaggtgccccagagcgaggtgtatcagtctgggccggattacttcttccagacgtcccgacagggcttgcaaacggtgaacctgactcaggcctttaaaaacttgcaaggcatgtggggcgttaaggccccggtgggcgatcgagccaccatctccagtctgctgacccccaacactcgcctgctgctgctcttgatcgcgccgttcaccaacagtagcactatcagccgcgactcgtacctgggtcatctcatcactctgtaccgcgaggccatcggtcaggctcagattgacgagcatacatatcaggagatcactaacgtgagccgggccctgggtcaggaagataccggcagcctggaggccacgttgaactttttgctaaccaaccggaggcaaaaaataccctcccagttcacgttaagcgccgaggaggagaggattctgcgatacgtgcagcagtccgtgagtctgtacttgatgcgggagggcgccaccgcttccacggctttagacatgacagctcggaacatggaaccgtccttttactccgcccaccggcc

SEQ ID NO: 8 - DNA, 874 bp, WUHARV Adenovirus 1 contig00095
ggcgagggcccctccaaccgccgtgttggtgaagaaccccgggaccgaaccgttggtgacggcgtgggagaagggcatggaagtcatgacgatgttgatggagaagttccacgtggacaacgagagcagagcggcttttaagtttctgcccgaccagggagccgtgtaccgcaagatctgtcaaacttggttgaacgaggagcaccgcggcctgccgctgaccttcaccaaccagaagaccttcaccgagctgatgggcagattcctcatggcttacatggaagcatacgcgggggtgaaacgcaagagctgggagcccaccggatgtgccgtttgggagcatcgcaatacccagcaggagggcgtcctgttctgcttccacggagtggagatggtctgcaaggagcacgtggtggaaatggatgtgaccagcgagaacggtcagcgggcgttgaaggagcatcctacgaaagccaaggtggtccagaaccgctgggggcgtaacgtggttcagctgaagaacgaagatgcacgctgctgcgcggaagacatcaactgcggcaataacgtattttctagcaagtcctgtgggctatttttcaccgagggtaccaaggcccagatggccttccgtcagatggaggagttcctggcggcgagttaccctatcatgcaacgcgggcagcgtcgcatcctaatccctctgcgctgcgattgcctcaacaaacccgacctggtgccccagatcggacggcagatgtgcaagctgactccgttgccctgagcaatgccgaggatctggatgcgtcggaggtgaccgacccaaggccctggccaggtatttacaaccccagcgtgctggtgttccagtgtg

SEQ ID NO: 9 - DNA, 840 bp, WUHARV Adenovirus 1 contig00102
ggggggtggcaaattcgtaccaggggtcggtttgcaacgccacttctttcgtaccaaccgcggcgggggtttcggtttgcgtttccatggcttccacggcggttgaagctgacgtaacggggatctggatatccaccgtctgcaccccgagtccaggggccacttctttgatcggcctgactttgacgtccggctctatgctggggtccactttcatcttctccaggacctcttccagcctctgccgtttaggaaccatgagctggatggtaggctgcagatcttccatttctctttttattcccctcttgctgtccgtgctggcgctcacggggagcacttgttgcagtgtcacgggtttgaggctgggtgtgggattgccgctgtctaaagcgatggccaagtctccgcgacgcgagcgctttccataggcgaattctccaatctgttgagccgcctgttccaatatgtcctcgtcgccgtacacctcgtcgtactgccttttgaaacccctaacggccgaccgctctcccggggtaaaaactaccgcggtgcccggcctcaaaacgcgttgtacccgccgccctttccattgaaccctgcgccgcggggcaaaactcctaataaattccactccgccatcgtctaccaccgcgagttcctctttcttttcccgctttttaacacgcttgatatcgcggggcttaatgtcaggcttcacgtccggagggccatagatctcaggcaccagcgtctgcagcagttcttctttaaacttgcgcttgctcatgttgggctaataacaacagggagactcagtaccgccgtcttcgcagctga

SEQ ID NO: 10 - DNA, 760 bp, WUHARV Adenovirus 1 contig00124
cctctcttgcaactgttgggggtccctggtttccagccaccgctcgagcttctcgtcgctgacgacgggctttccgtcctctgagttttccgcctcggggtggtcgggatccaggggctcagctctcttgatgagcagctgatccatgaccgatttcataactttgggtggcaagttgagggcggggtaggcgaagtgggagacttctatgcagcgtttgaggacggccagacgcgcgttgtccccctccagctccaccagcacgttctgactctctttctgttctttctgcagagcgttcgccgcccgcttctcatctcgacccagaccctcgaagatcttaggcacttcctccagtgacgtgatatcaggtatgctggctccgtttctgagtgttagcttcctatcggctgcggtgcggttggcccggcaggaaaggggaatgcgctggtttttgaaaaagatgtggtaggtggccagcgcctcgggcacggcgaacacggggtagaagttgagtcgcgggttgggctcgcaggtgccgttgggctgtctcttcggaggcactcggggcgagaaaaggttcgcctcgtaggcctgggagagcgcggcgacgtccaagggcacctcggagcggtcttgcaaggcctccttgagtatggtgctctgcctggcgaaatgctttagcaagacgtcgccttccaggaggtagcagccctcctcctcctctttctcattttcctgccgctcactagcgccgctg

SEQ ID NO: 11 - DNA, 629 bp, WUHARV Adenovirus 1 contig00165
tgcttggcggttcccttgggcggcatgtctcgggggggctgcttcgacggagagtgtggacgggttgagttcctcgccggtctgggggtctaagtacaccccccgaccctttttcaaaaggaaatctcggcgcgcttggttgatggattgcaattgggccaggatcttgctctgggtgatgacgcaggccgtgaggggggctttcggtggtcgagattggtcttcgtaaaactgaattttgtgggcgtggtagtcctcggctacaaatttgcgtaagtaagccgaggtccacagcgccggagtgagcttcaagccggaagcaccctcttgctgctggggtccctggatctcgaaggtacctatgacctgggtttcgctgagcagctcggtgttgcaggccagcgatctgtggggggtgcacaggttgcagcggcagtggcactccagtaaaccctctccgcttacgtcttccatgaggtcggagtggtaggccagaaagttggccagttggaagaggtagcagtggctccacagtgggggagggacactcgcggtaggagagggggtacaaagtcagaaggtagcgcgcagctcatggcgggcaagtattcccggagccgttccaggac

SEQ ID NO: 12 - DNA, 562 bp, WUHARV Adenovirus 1 contig00196
gtcggcaatcacggcgtctatggtatcgtctacagccgttcggccagagagtcctcgcttgtaagctccccagggagcgcggaagtggccccgaactcgaactgggtgctgactggagcgccttttggctccgccgtacatcttgccggagcccagtccccagccggtgttgttatcgggagagatgaggatggacatgtttagaaggtgcgactagagagaactttgggagccactacgccaagagctttgtaaacgtagggacaggttcgacgtctggcgtcggtgatggtcacgcgctgaactccactgatactgctgcgcagcggtagggttccgtgatctgtgagggcgggaacgttttcactgacggtggtaatggtaggagcgggagggcgcaccagaatctggttctcgggaaagcgattgaacacgtgggtaagcgcggtggactggcgaatgagttgcgagtaaacggcctgctcgttgtagaagctcttggcatggacgggcagcagctcggtgcccaccaccggaaagttgctgacctgggtggagggcg

SEQ ID NO: 13 - DNA, 458 bp, WUHARV Adenovirus 1 contig00257
gttgaggacggtgggccgctggggggcgtccgcgggcagttgggaggtgatgctgctgatgatgtaattaaagtaggcggtcttcaggcggcggatggtggcgaggaggaccacgtctttgggcccggcctgttgaatgcgcaggcgctcggccatgccccaggcctcgctctgacagcgacgcaggtctttgtagtagtcttgcatcagtctctccaccggaacctctgcttctcccctgtctgccatgcgagtcgagccgaagccccgcaggggttgcagcaacgctaggtcggccacgaccctctcggccagcacggcctgttggatctgcgtgagggtggtctggaagtcgtccaggtccacgaagcggtgataggcccccgtgttgatggtgtaggtgcagttggccataacggaccagttgacgacttgcatgccgggttgggtgatctcct

SEQ ID NO: 14 - DNA, 2930 bp, WUHARV Adenovirus 2 and 3 contig00003
tgcggggtgacgcggggtggcgcgagggcggggcgggcgaagggcgtgtgtgggaaagggaaaaaggcgcgcggaagtgacgttgtgagactgaaattgcggaagtgctgacggcgctggattttcgcgggttttgtgggtgtgggtgaactttggtcgtgggtggtgcggtgttagcgtcattgggcggagtgtatatatagctataggctgttgggtggattttagctcgactttttcgtggctttatacgcggtaagacggggcaatggctgatcaacatatatatgtgcatttgctgggacgtcgggcctttttgccccagcaacagggttattctaatatgtatgttcttttttcaccggaggattttgtgcttgctcccagagggattattttgctgtctttgcagctgtcgttggatattcccactgggtatctgggacgttttttttctgtggcggatatgaatgtgaggggggtattgctgtgtgctcaggagatccaaccgagtacatggtgggaagtttctgttgttctttttaatcattcggatgaattttaccgcggttcccggggacagccggttgcttgcctgctgctggagcgtgtcatatatcccaccgttcgccaagcttctttagtttaatgtttatttttattttaggtcaacatgtatctgagccgccctattttttttgctgtgcatattcccgcacagttgcttcagtacttgcacggactgaatatagaagtactggactttttaaaggagcagcttagtgatttttggctgaacattttacactgtgttactcccattcatcagttttgctactcgggagcggttctagtgagtttggcgccatccctggaacttttgtgctgcatagccacacctgatttagttcctagcgcggagttaacagatttagtcggcgcagatctatttaattatttgcaaatgaccttgcggatggagattcgcgatcgcggagagcaacctgacctgggtctgttaaatctgctgcaggtgtctcaggagcccgatatcttgcagtcatgatggtgtgtctacgcatggctatagagggcgccctttcggagctttttaatatgcacggcatgaaccttcagactatttgccgcgacatcattcgcgagtggagaaatgaaaattacttgggcattgtacagtcctgcagcttgatgatcgaagagtttgataataacgcttttgctttgctggtgtttgtggaagtgcgggtccaggctcttttggaggccgcgattgatagcctggaaaatcgcataatgtttgatctggctgttaaattccatcagggctccggaggcgaccgttgtcatcttcgggatcttcatttcgacccgttggtgaatcgcttggaataacatgcctcttccgtgtcttcctccacctccagtgtgtcgggatagatcaggctgtctgtcttggttggaactcgccctcactacgtgtttggaactgtaccgagacatctgtaggtttgaggtgtgcatcgccccggaggccgagagggatctgtgtggattacaagagtggttgcactttgcgttgaggagggagcgtgagcgacgcagggaccggcgttacttggagacgtgctggcagcggacgtggttctgctactacaagtacgaggaagtgcgtcggtccctggtctacgatgcaacgcgacagacggtatcgctgcagactggctccctacaatcgtcaccagctaccaccttgtgaggaccgcggcagtgctgttgtagaggagaactctcggtacttagaatgtgaaaatatgaacatgcacaatgttagtgaggtgaggagtataccatcttgtattagctttattgtactgcaggagtggcccgtgtattgggattgtattttaacggcctgggaaaaacatgtgatgaaaatgtatatgaaagtgtgtatctgctgtgccacgttagatctggatttccatcagaccattaggggttatgagagatggattattcactgtcattgtaactctcaccggttctcttcagtgtagagctggtggggcggtgttagctaattggtttaagatggctatctatggctccctgataaatgtgaggtttccctggtacaggcaggtggtgaacaggggactgccccgggaggttctgtatgcgggtagcatgtttgtacgcggcagacacctgatttatgttaaagtaaggttggacggacacgcggtggcgctgttggagcgaatgagctttggctggagcgtgttcagctatgggatcatgaacaacctgattgtgatggtgtgcgattcttgccggaatctcagtgagattcagatgcgctgctgcgccagacgcactcgtagactgatgatccatgctgtgaggctgctggacaatctaacttcttaccagcctcacaggagtcgcaccgagaggttcagacagcgccactgcgtggtttagtggaacatcatcacacctttaccctgtctgagtttgatcggggagataacccgtggagagcctgaacctgtttgttttgtagggcggcatgcagtttttcaccgaaacgttggagaacctgccccagggatttgtgtccatcacggatcgacatctgattaccaaagagactgtttggatcttaactcccaaataccggactggctcgcagcagtttactgccatgaagggggagaggctggtgtatgctgtcaaatggaagggtggaggaagccttactgtgcgtgtaaaataaaaagaaatgaaaaataaaaaagttgttttattgttctgtaatgtaagaaaacgaacagcaaggaatatcaaacttttcattagccaccacacgccatgtaaactttaaggagtagccttcaaggacatgt

SEQ ID NO: 15 - DNA, 1933 bp, WUHARV Adenovirus 2 and 3 contig00006
tttttaagtagaagtacagtttaacgccaatgcaggttgctacaaaaactaaaaccgctgtggctacgtaaagccaggcaataggggtttcaggcagtacatcgtaacaggtgtaaaaggaccaaggtttggtaaaagggcaatgacattttgcgagggtaaacagagtgtgcagtataaataggcgaatcatgctagacaaagtaaagaagctacgttttgattccgatactcggggtgatgtctaaaataagcaaaccgtacgtagagataatcggcggcttggaaaattgttacaaaaaagcaggctatactggtaatggctgtacagaccacaaaagtcagtattaggtatacaacaaaaggtggtagacagtctggttccaggtgggaaacagcggcaaaagttgtggaggtgcagatgattggtatacagagaagaatgaagaaggcagctaccattctggaaaaaaattaaagtaaacgaatttcaggagcatcagactttttggtttttgaggtcctacagtaataaatgaggtaagcaattcctagaataattactatacagctaaccactgcaattactatgaaaattggtgaaaaatcagagcctgtttcaagtgcgataatatcattacataaatcattaaatggataagtgaagttatagctatgtttaagattgtggaagtcaaaagtggtagtgtaaaaatttggtaaattgcctccgccaccgcgttcatttaaaaagtagtggcgtttgctccgtttgccattgtagtgtacaaaaacgggatatttagagctggcacaattaatagttataatgcaactatcctgggtaggtggctcagtaacatagtaagaagaaatttcacattgaggacgaggcagatcaataacaaaaagattgaagtatgtgttgcgttctacaaagttggtgtagactttggcattgtaaataccagagtagctctggcgcacgttaaagagagtaagactttcatttgtacagtcaaactgcaggggataatgttcccattttgttttttcactgttaaagaagttgcaaagcagctgtccttgaaagaagtagggcaatgtttgattaaaaattgaataaaagtcttcctctttgtaccagctcatgtggttgatggaaaggacagagtttacagctggaaggtgctgagtagagttaggaagtttaagggttatgttagttcctacctgagcataaatgtcaattacttggttggcgatgttgccataagaggcggtaaacaggaaaaacaaaattacaattgaattcataatgaagctagtttttcaattaaaatgaaatttagcaaaataatgaggatgaaaacggacaggctaagtaaaggacttggatgacggtgaacaggtggagaataaatgaagcgcttggaagctagagtggaattagaaatgttaaacacaggagaaggctccacagactttaaaaatgaacggtggtagcagcttgggccgtttccagtcccaatacaaaagtactgaactgctgaaaaaggagctgttagggttaaactacgaagggtagcgtttccacacagagagttatttcgctgataaagaactgttgagtatatgaaggttatacaaattgtgccgttagcaaaccactgagttagttcgttagagcaagagcagttgagggttagaagagtagtagagttgtcaaagtaaacagtttctttaatacctttgattgaagagcctttagtggtagaaacgacgcgtggcgttgagggtgcggcaaaaagttcagtttttattaaactgagcgcaaagatgacaacacagatcttcatgtaatccgggcgtggggcagatgcagaacagggtgatggtagtgatcccgcgttcggtttccacctggagaggt

SEQ ID NO: 16 - DNA, 1691 bp, WUHARV Adenovirus 2 and 3 contig00007
gctacacacttatcctacgctactcctcccctttaatcctaactgacaataatttaaccgtaggcttctcaagtcctctccgtgttatagacaacaaactgacattcacttttacctcacctctccgttatgaaaacgaaaccattaccttcaattacacagagccccttacacttatgaacagcaaccttgcgcttaacgtaaactcctctaaaggccttagggttgacgggggctcactaggtacaaacctaagtccggacttaaggtttaacagcagtggagccatagcttttggtatacaaaccctatggacacccccgacctcaaatcctaactgcaccgtttacaccgaaagcgattccttacttagtctctgcttaactaaatgcggagctcacgttttaggaagtgtaagcttaaccggggtagcaggtaccatgacaaacatggctgaaacttcgcttgctattgaatttacgtttgacgacactggaaaactacttcactcaccacttgttaacaccacttttagcattcgtcagggcgacagccccgcctcaaatcctacctacaatgctctagcatttatgccaaacagtaccctctacgctagaggaggaagtggtgaaccccgaaacaattactacgtccaaacatacctcaggggaaatgttcagagaccgattaccctcactgttactttcaactcagccgccacgggatattccttatcttttaagtggactgctgttgtacgtgaaaaatttgcagctcctgcaacttcattttgctacattaccgaacaataaaaccctgtgttcccaccgtttcgttttttccagatgaaacgggccagagttgatgaagacttcaatcccgtgtacccttacgatcccccttacgcccccattatgccgtttattaccccgccgtttacatcttcagatgggttacaggaaaaaccacttggtgttttaagtttaaaatacaaggatcctatcactacacaaaatggttctctaacccttaaattaggaaacgggctgaacatcaacaaccagggccaacttacatcatctgctggggaagtcgaccctcccctcaccaatgctgacaacaagctggccttagcctacagcgaccctctgacattaaaaaacagccgtctaacactgtctcacaatgccccacttgcaattaacaataattctctaagtttggaagtatcagagcctatatttataaataacgacaacaaactgtctctgaaagctgacgcccccctgacaaccagcgctgggaccctccgcctgcaaagcgctgctccattaggacttgctgaacagacactaaagctgctgttttctaaccctttgtacttgcgaggtgacttccttacattagccattgaacgcccattggctgtaacagcagacgggctattatcacttgtcctcaaccctccgctcacaacaactaacacaggcttagctctctctaccgcggttccattgactgttaacaacgggaaccttagcctaaacgtaaaacggccgtttattatacaggacggcagcctttacatggattttagaccccccctatatctgtttaacagcgagccgcaacttggtgttaattttaatgcccctctaactgttagagataacggcctagctataaacaga

SEQ ID NO: 17 - DNA, 1502 bp, WUHARV Adenovirus 2 and 3 contig00008
tttttactgctgttgttgaattttccacctacagagaaacgtatgccaagcggccttacaatttctcatacccgtttaacgacctttgcaatgaaatacaagcgctcgaaactggaactgattttactccaattttcattgctgccattgttgtgagcttaattaccattattgtcagcctagcattttactgcttttgcaagcccaaaaaacctaagtttgaaaaacttaaactaaaacctgtcattcaacaagtgtgattttgttttccagcatggtagctgcatttctacttctcctctgtctacccatcattttcgtctcttcaactttcgccgcagtttcccacctggaaccagagtgcctaccgccttttgacgtgtatctgattctcacctttgtttgttgtatatccatttgcagtatagcctgcttttttataacaatctttcaagccgccgactatctttacgtgcgaattgcttactttagacaccatcctgaatacagaaatcaaaacgttgcctccttactttgtttggcatgattaagctattgctaatacttaattatttacccctaatcaactgtaattgtccattcaccaaaccctggtcattctacacctgttatgataaaatccccgacactcctgttgcttggctttacgcagccaccgccgctttggtatttgtatctacttgccttggagtaaaattgtattttattctacacactgggtggctacatcccagagaagatttacctagacatcctcttgtaaacgcttttcaattacagcctctgcctcctcctgatcttcttcctcgagctccctctattgtgagctactttcaactcaccggtggagatgactgactctcaggacattaatattagtgtggaaagaatagctgctcagcgtcagcgagaaacgcgagtgttggaatacctggaactacaacagcttaaggagtcccactggtgtgagaaaggagtgctgtgtcatgttaagcaggcagccctttcctacgatgtcagcgttcagggacatgaactgtcttacactttgcctttgcagaaacaaaccttctgcaccatgatgggctctacctccatcacaatcacccaacaagccgggcctgtagagggggctatcctctgtcactgtcacgcacctgattgcatgtccaaactaatcaaaactctctgtgctttaggtgatatttttaaaatgtaaatcataataaacttaccttaaatttgacaacaattttctggtgacatcattcagcagcaccactttaccctcttcccagctctcgtatgggatgcgatagtgggtggcaaacttcctccaaaccctaaaagaaatattggtatccacttccttgtcctcacccacaattttcatcttttcatagatgaaaagaaccagagttgatgaagacttcaaccccgtctacccctatgacaccacaaccactcctgcagttcccttt

SEQ ID NO: 18 - DNA, 1409 bp, WUHARV Adenovirus 2 and 3 contig00009
cacattcagggcatcttcttgaaccagagaccgagatgccacagctgccgtggccagttggttatacagtccaaaatcagccgccatgccgcgagcagtagaagcggcagcagaagcggcagctgccgcggcagtgtccaacgatgatcccacggtggcataggtgagggtggcggaatttgcaggagcgaccggccgtccgtccacggtggagcccactacattctgacgcactcctgcccaggaaggaagacgagatgtcagatatgggctgaacactcccccctcaaacgcattgccgtccgtcgtcccgctcattttgaaacaccgcgtccacccttcatgcccctttataccctttgtggctccgcccctcacctcactcctcatcactggattcatagtcggtacgcaggcaagactgcatgtggtggtccgttctcagctcctcggtgacgttcagagttacaggatacaacctcaaatgattagctccgcattcacatgggcgacaacgagacttggtttcatcatatcttatcactttaaaaagttccattgacatgtcaaacaccccattgaaacatactcgaggaaggaatcagtttccagcaaaatcttagtatgactaaagttacattgataaggcataaacacgccgcgtctagcacctaggtgaacggcgcaacgcatgagcatattgtgctcaaatgttggccaggtgcggcgcgagtgggacactatgtgcacggtgcgcaaggtgtgacagtttccatctgcgcaagttaagagctgcgaggggcacaggccgctgccgcaaatcatattatgcttaacgctggccgtacctttcagcaaaagaaaacatccattctcagatgcggcgttattcctgatccgtccgtacccctctactgctagagctatcacacagcgttcaaatatgcatttcttcacagacatgacacttttaattcttcccaccaccgctttccagcaaccatgaaaactgcagcccctcagagacaccctaccccatgactccacacatgtattgttaaagttaaaaagtaaacaccgtggagggttagctgggtgctagtcacaaacacagagccattaaaatcatcaccagtaaacctgacattttgaaatgtaactccattcaaacctatcaccccggggcccaaactctgcataccgcaattgaaagccacccggtctggggtctgcacctgcaccagagctccatggccgataacataaacactcttttttatattaacagtgcggcgaatagtgtaaactttatccggccgcagagccactttagcaaaggtgtctagagccatttccatatcctcccacggctccaaccagtgagttttcaactgctcaaacccatactt

SEQ ID NO: 19 - DNA, 1265 bp, WUHARV Adenovirus 2 and 3 contig00010
agaggtttgtttccttcataaaatgaagaattaggtttggaggtttgtaagtaccacgtaatatggggtatctggtcggaatctggcatgtaagcagattgaagagttgcattgtaacctgcgccaacaatacttgttctggcgtgagagagagcgaaaaatgtggcgagcaggaggataacaagcatgtttactgtaagttgttaattattataaagttaataaagattatcagtatcaaagctaaaataccaattagaggtttgaaagagtaaccagagggagaacagcagtaggacagggtgaaaaaagaaacagaattgttgggaagggtctctttttgtagaaaccacttatgaaagcaactaggatttaaaccggagccaacgcacatataccatccagtaacaaatgggggataaaggattagtgtggaggagttgcagtgcttgcaaaggctgttatttctactaactatctcgttcccccaaaagtacttgcacacactaccgtttgcaatccactggataagttcgttagtgcaggcgcagttcagcacaatagatgaggtagaattagaataaaatacagtttgtgtacctttgccagaagaactttttgttgtagaaatcacagatggcgttgaaggtgcggcaaacagttcagtttttattaaactgagcgcaaagatgacaacacaggtcttcatgtaatccgggcgtggggcagatgcagaacagggtgatggtagtgatcccgcgttcggtttctaccaggagaggccgggcggtgaaggcgtcgatgaggcgagactcgagcgcgttctcgatctcgagtttcaacccgtgagccggcccctgagggtgctcgtccggcagctcaaagtagctgaacacgatcgcctcccgagcgtagcagcgaggctggcggcagtgatgcagatgtcgcagccgagctctcacggccgcaccatctgtcatcagtcgtagccgtccacggattcactcactgcgtcaaagttgggaatgaaggcgtccgggtagcgtccaggtgagccggaaaacgggttgaagtagacggaggggacgaactcttccacgaactggagagtgccgattcccccggagcgcggctgcgaggaagagctctgcagggtcaggtaggcctggcgagtggtgaaggaagagcggcccgctcctccgagctggaagactccgtcaggtctgagaccggttgaggagctcaccgcctcgtcgttgagctgg

SEQ ID NO: 20 - DNA, 1152 bp, WUHARV Adenovirus 2 and 3 contig00013
ttttttaggcctttgtctcggagtggtcccagttcctgtacgcggaagacctcggaacacctttggaagatcgccccctcaagtcggtctacggggacaccgacagcctttttgtcacggaagcgggacacagactcatggagacgcaaggtaagaaacgcatcaaaaaaatggaggcaacttggtttttgatcccgctaaacccgagctcacgtggctggtggagtgcgagaccgtctgcgctcagtgcggagccgacgcctactcgcccgagtcggtcttcctggcccccaaactctacgccctcaagtgtctgcactgcaccaaatgtcagcacgtttccaagggaaagctgcgcgccaagggacacgcggccgagtccctcagctacgacctcatgcttcgttgctatctggccgactcacagggagacgacgcccgcttcagcaccagcaggatgagcctgaagcgcaccctcgcaagcgcccagcccggggctcatcccttcaccgtcaccgagaccaccctcacccgaacgctgagaccctggaaggacagaaccctcgcggccctggacgcccaccggctggtgccctacagcgaaagtcggcccaacccccgcaaccaagaagtctgctggatcgagattccatagagcacgtcaccgagctctgggaccgactgtacttgcttcgtcagtcgcttgaaaagatgcccatggccgacggcctgaaaccgctgaaacacttcaacagcctggaagaactcttatccctgggtggggagaggctcttgcaaaacttagtgagtgaaaataaacatgtcagaagcatgatgaacgatgtagcccccctcctgcgccccgacggcagctgttcctctctcaactaccagctgcaacccgtcatcggggtcatctacggtcccaccggttgcggcaaatcccaactgttgcgtaacttgctttccacccagctcatcaatcccccgccagaaaccgtgttctttatcgccccccaggtggacatgatacccccctcggaaattaaggcctgggagatgcagatctgtgagggcaactacgctccaggcccagatggaactatcatcccccagtcgggcaccctcctaccccgctttgttaagatggcc

SEQ ID NO: 21 - DNA, 1074 bp, WUHARV Adenovirus 2 and 3 contig00017
ataggctctgaaacttgcaatgctaaagagttatcagcaataacaaggggagcggtgtgcgataaggttaggctgttgcgctttactgctaaaggatcgctatagaccagtgcaagtttgttgttagcgttagtgagtggaggttctacttccccagcggttgatgttagttgtccctggttgtctagagtgaggccgtttcctagtttaactgtaagagacccattttgcgtagtaatgggatctctgtagtttaaacttaacactccaagtggtttttcctgcaacccatccgaggaggtaaaaggtggagtaatgaagggcataacgggagcatgtggggggtcataagggtacactgggttgaagtcttcatcaactctcgcccgtttcatctgaaaaaaacgaaacggtggggtacacggttttattgttctgtaatgtagcaaaacgaagttgttggggttgcaaacttttcacgtgcaagagcagtccacttaaaagataaggaatatcctgtggcggctgagttgtaggttacagtaagaatgattggtttttgaacatttcccctaagatacgtttggacgtagtagttgtttcgtggttcaccacctccccctcttgcatatatggtactgttaggcataaacgccagggcgttgtaggtagggtttgaggccgtactgtcattctgtcgaatactaaaggcgttgtttataagcggagagcttagtagcttaccattgttgtcaaatgtaaattgaatggtgacagaaatatcagtcatttgggttatggttcctgttaaaccggttaaacttacacttcctaagacgtgagctccgcatttggttaaacagagactaagtagggaatcgccctcgctgtagacggtgcagttgccagtcgaggtcggagcggtccacagggtttgatgccaaaagctatggatccgttgctgtcaaactttaagtctgaactcaggtttacagctagtgagcctccgacgctactaaggccttttgaggaattgatgtcaatggcaaggctgttatttataagtttaagagg

SEQ ID NO: 22 - DNA, 1044 bp, WUHARV Adenovirus 2 and 3 contig00018
taccgtctgcctgagactctgaccgccacgggtttaataatgccaactggaaccacagcccccaaagtgcaaggagaattagcagaccctgatctatctccgtccccttccgtgtcagacacgtcacctgtaaaacattacacaaacaataagcccaacacactttaacaatcccaccaccatgcgcaaatcgaaaaagctcctacttactgtatacaaaatcgctggtaagacgcaggtaacacagagcacataaagtttcaggatttccgctggcatttctatgaaaagcacaggcacggcagccatgaccaggttgatcaggacagtctaatacaagttcatttttcactaccggctcagtacagcagtctccccctgtctgttccgtttcagaatcgctagaaggcagacattcctcgtagcatttcaagtccagttcctctccccgtttgctctcttcactgctgtgagaaccctcctcagccgcctcaaacagacattcagggaacatactgtttaccgcgtcctcgttgggatcttgcggtggatccacttccacatcgaaaagatcatgaagcgacggaggcgaagccacaggcgagttgggaacatccagcagatctgtattaagcagctcatctgagttccggaccgtctcgctgcagaaaacaccgtacatctcggggaccagcctcatcgcggcagcgcggaggagaaaactctactcgccggcactcaagagtggcctcttgatgatctgacagcgtttaaatacccagcgaaaacgctgaggagtacaataaatgggacctttgagccttctcgtggtactgccacgtagcgaaacctccccgtcagcgcccaaagttcactgctgatcagcagaaattccgcccagtcataaaaagtacatattaacctcaacttcctcattacccagttttcgcgccaaactacacaaaacttacaagtatacgcccaaattacccaacttccggtataaaacctccttccgcatacgtaaaaactaagcgcctccgc

SEQ ID NO: 23 - DNA, 929 bp, WUHARV Adenovirus 2 and 3 contig00024
cacaccgaactgggtgctgactggagcgccttttggctccgccgtacatcttgccggagcccagtccccagcaagcggtgttgttatcgggagagatgaggatggacatgtttttagaaggtgcgactagaaagaactttaggagccaccacgccaagcgctttgtaaacgtaggggcaggttcgacgtctggcgtcggtgatggtcacgcgctgaactccactgatactgctgcgcagcggcagggttccgtgatctgtgagggcgggaacgttttcactgacggtggtaatggtaggagcgggagggcgcaccagaatctggttctcgggaaagcgattgaacacgtgggtaagcgcggtggactggcgaataagttgcgagtagacggcctgctcgttgtagaagctcttggcatggacgggcagcagctcggtgcccaccaccgggaagttgctgacttgggtggaggggcggaaggtgaccgggtcttgcatcatatccggcagggaccagtacacttgctgcgagccacaggtcacgtccgtggtggtgagtatggtccatgatctcactcctttctcggggtctccgtagttgtaagccagaaaccagctccgatacagggtgtccgtcgtgttgtttataatattgtagcttctgtctttgctgtctttagttaaaggcactatttccaggtcctggggagctaccgcaaaggtgtctcccccgaatctctctaccctccgctttggcgcgttgtatgctagcttcgtacttcgacacgtccagtaaggcgggtatattacctccctccaggtcctcatacatgatttgaaagccctcttggaatgggcggcgctttctaattcctaacaggttactcaaacggctctgagtgaagtccacaccgcaccccggcagcagca

SEQ ID NO: 24 - DNA, 876 bp, WUHARV Adenovirus 2 and 3 contig00025
gggaggacagtcagccgcgaccgctggttccgccgcactggcgtcgtcagagagaagacccggacgactccgcagacgatagtagcgtgttggacctgggagggagcggagccaacccctttgctcacttgcaacccaaggggcgttcgagtcgcctctactaataaaaaagaagcggaaacttaccagagccatggccacagcgtgtgtgctttcttcctctctttcttcctcggcgcggcagaatgagaagagcggtgagagtcacgccggcggcgtatgagggtccgcccccttcttacgaaagcgtgatgggatcagcgaacgtgccggccacgctggaggcgccttacgttcctcccagatacctgggacctacggagggcagaaacagcatccgttactccgagctggcacccctgtacgataccaccaaggtgtacctggtggacaacaagtcggcggacatcgcctccctgaattatcaaaacgatcacagcaactttctgactaccgtggtgcagaacaatgacttcaccccgacggaggcgggcacgcagaccattaactttgacgagcgttcccgctggggcggtcagctgaaaaccatcctgcacaccaacatgcccaacatcaacgagttcatgtccaccaacaagttcagggctaagctgatggtagaaaaaagtaatgcggaaactcggcagccccgatacgagtggttcgagtttaccattccagagggcaactattccgaaactatgactatcgatctcatgaataacgcgatcgtggacaattacctgcaagtggggagacagaacggggtgctggaaagcgatataggcgtgaaattcgataccagaaacttccgac

SEQ ID NO: 25 - DNA, 839 bp, WUHARV Adenovirus 2 and 3 contig00027
ggcgtccgtgtcttgcaacgcgtcttcccacttcttcaccgccagggccctttcgtagggattcaggggcggtccccagggcatggggtgggtcagggccgaggcgtacatgccgcagatgtcgtacacgaacaggggctcccgcaacaccccgatgtaagtggggtaacagcgccccccgcggatgctggctcgcacgtagtcgtacatctcgtgagagggagccatgagcccgtctcccaagtgggtcttgtggggtttctcggcccggtagaggatctgcctgaagatggcgtgggagttggaagagatggtggggcgttggaagacattaaagttggcccccgggcagtcccacggagtcttggatgaactgggcgtaggattcccggagcttgtccaccagggctgcggttaccagcacgtcgagagcgcagtagtccaacgtctcgcggaccaggttgtaggccgtctcttgtttttctcccacagttcgcggttgaggaggtatcctcgcggtctttccagtactcttcggcgggaaatcctttttcgtccgctcggtagacctaacatgtaaattcgttcacggctttgtatggacaacagcctttttctaccggcagggcgtacgcttgagcggccttttctaagagaggtgtgggtgaagggcgaaggtgtcccgaccatcactttcaggtactgatgtttgaagtccgtgtcgtcgcaggcgccctgttcccacagcgtgaagtcggtgcgctttttctgcctgggattggggagggcgaatgtgacgtcgttaaagaggattttcccggcgcggggcatgaagttgc

SEQ ID NO: 26 - DNA, 779 bp, WUHARV Adenovirus 2 and 3 contig00032
aatagtttcgaggttcagactcagtcttttgcttcttcctagccccactagtcccctcttcgggatcatcctcagcacctagtcctccgttggagggtccagcccggccctcaggttctcggtctccccggctcgtcctcctcctccactcggtccagccgcggaggctgcgcccgcaagtaaatgcaaaccctcctccgcagcatggccctccacagcgccatcgacatgtaatccagcatgtactcccacgacaggtgactgccgctgttgctccattgatccaaaatataggtaataaaggcagcggaagcaaccgtgcgaccaggagacgaaaaagttaagtttttgatgattttttcttgaaaaagagagtgatggcctagatccagagccacaaaaactccaggagtatcggccaacagcctagcaaactgcgtctcctgctccttcttgaccctataaagcacgttgctaagcgttgagccaaaccaaaacctccaaagcctggaagttttgtcagaggccaactccagcaagcggcgaaccacgtcaaattccctcaagttcctaagagatccattaaggcagctgtgctctcacttcccattcacctgcttatatacccacagacacacccaacacataaacacagttcaaagatcaacacttttattgcatacaataaacacacttaggtcagcttagggcgtttcatggataggtccaaaggttccgtctgttcttcctgcagcaagtcttccaatttttcaactgca

SEQ ID NO: 27 - DNA, 782 bp, WUHARV Adenovirus 2 and 3 contig00033
aggttcttaatggcaaagaatttttgaggcacctgaatgtggaagggcacgtagcggccgttgcctagaagcatggagcgataacgcagaccagcattgcgatggtgattaaaaggattcacgttgtccatggggtcgggagaccatcgcgcgccaatgtttacaaaggtgtctaccagaccaggagctgttactcgaccattaatgtaattgtaactgtttttgttttcgggtaaggttatgtttcccggtgaatacttgtaggagtctggcaggtacaaagcaatattggaatacagaaagtttcgccacaagttagcagttaaatttatctccatggcaaaaacatttcctatgccaatttcgttagtttctactactgcgtcgtctttcgcccaattgccgttgtttttcttaacgcctttataggtgttagcaattccttgagcgttaagagggaagcagtaatttggcagttcgtcctcaacgccatgattttcaataattcgcacatctggatcatagctgtccactgcttggttccacattgaaaagtaacgactccggtctcctattgcatctaacatgagttggtaggaaagctcagtgtttctgtcttgcaagtctaccacagcatttagttgggaagcctgccctgccaacactcccatgtttcctgttgaattatagtacattagtccaatgaagttgtcccgaaaggcaatgtaattggctctgtttggagcggcctgttgacccaaaaggttttcagagtttgtgtt

SEQ ID NO: 28 - DNA, 639 bp, WUHARV Adenovirus 2 and 3 contig00046
ctcctatgttaccgccagagacgagtgactgtcgccgcgagcgccgctttcaagatggccaccccatcgatgatgccgcagtggtcttacatgcacatcgccggccaggacgcctcggagtacctgagtcccggcctcgtgcagtttgcccgcgccaccgacacctacttcagcttgggaaacaagtttagaaatcccaccgtggcccccacgcacgatgtgaccacggatcgttcgcagaggctgactctgcgctttgtaccggtagaccgtgaggatactgcctattcttacaaagttcggtatacgttagccgtaggagacaacagggtgctggacatggccagtacttactttgacatccgcggtgttcttgaccgcggtccaagctttaaaccgtataccggaacggcatacaatgccttggctccaaagggcgctccaaatgcttgccagtggacaacgaccaacgggggcaataaaacgaacacttttgcccaagcccctttaataggcacggctattgacggaaccaacggactgcagattgggcaagataatggacaagctgtttatgctgacaaaacctttcaacccgaaccacaagtgggagaatctcagtggaatactaatccaacc

SEQ ID NO: 29 - DNA, 603 bp, WUHARV Adenovirus 2 and 3 contig00053
gaaaggaacggctggagtggttgtggtgtcataagggtagacggggttgaagtcttcatcaactcgggttcttttcatctatgaaaagatgaaaattgtgggtaaggacaaggaagtggatattaatatttgttttagggtttggaggaagtttgccgcccaccatcacgtcccatacgagagttgggaagagggtaaagtggtgctgctgaatgatgttaccaaaaaactgctgtcaaatttaaggtaagtttattgatactgacttacattttaaatatatcacctaaggcacagagagttctaattagtttgggcatacaatcaggcgcgtgacagtgacacaggatagctccctcaacaggtccggtttgttgggtgattgtgatggaggtagagcccatcatggtgcagaaggtttgtttttgcgaaggcaaagtgtaagacagttcatgtccctgaaggctgacatcgtaagaaagggctgcctgcttaacatgacacagcactcctttctcacaccagtgggactctttaagctgctgtagttcaaagtactccagcacccgagtttctcgctgacgctgagcggctattctttcc

SEQ ID NO: 30 - DNA, 580 bp, WUHARV Adenovirus 2 and 3 contig00058
gatggaactatccatcccccagtcgggcaccctcctaccccgctttgttaagatggcctatgatgagctcactctagagcaaaactatgatgtttccaacccccaaaacgtgtttgccaaagcggccgccaggggtcccattgccatcattatggatgagtgcatggaaaacctagggggtcacaagggggtctctaaattcttccacgccttcccctccaaactgcatgacaagttccccaagtgcaccggctacaccgtgctggtggtccttcataacatgaacccccgcagggacctaggtggtaacatagctaacctcaaaattcaagccaagatgcatatcatctccccccgcatgcatccctcccagcttaaccgctttgttaacacctacactaaggggctgcccttggccatcagcctgctcctaaaggacatcttccagttccacgctcagaaaccctgctacgactgggttatttacaacaccaccccggagcatgacgctcttcaatggtcctatcttcaccccaaagatggccttatgcccatgtacttgaacatccaagccgctctg

SEQ ID NO: 31 - DNA, 580 bp, WUHARV Adenovirus 2 and 3 contig00059
cttgcaatatgaaaatggagctgcagctgttaagctaagtaccgcccctcctctacagtatactactcaactgcagctgaatttgggagcgggcttacgtctaggtcctactaggaacttagacgtggccattaacccaaataaagggttaacgtgggaaaacaatgaagtggttactaaattaggacagggcctttactttgattcctccggaagcatagctttatcgcctacaaaccccagaccagatactttatggaccacggccgatccttcgccaaactgcactgtatatgaatcacttgattctagactgtggctagcgcttgttaaatgtgggggaatggtacacggcagcatagccctacaagctgaaaaaggccaattgctgcgtcctactgctagttttatctccatcgtaatctacttctacagtgatggggtccgtcgcaccaactaccccacaattggtaatgatgagggtactctggccaacagcgctacttggggctacagacaagggcaatctgcagacaccaacgtcaccaatgctgttgaattcatgcctagtttacacctc

SEQ ID NO: 32 - DNA, 559 bp, WUHARV Adenovirus 2 and 3 contig00062
ctccgcccgggcccagtcggagagctgagggttagccgcgaggaaagagctccacaggtcaagggctagcagagtttgcaagcggtcgcggaactcgcgaaactttttcccacggccattttctccggcgtcaccacgtagaaagtgcagggggcggtcgttccagacgtcccatcggagctctagggccagctcgcaggcttggaacgagggtctcctcgcccgagacgtgcatgaccagcatgaagggtaccaactgtttcccgaacgagcccatccatgtgtaggtttctacgtcgtaggtgacaaagagccgctgggcgcgcgcgtgggagccgatcgggaagaagctgatctcctgccaccagttggaggaatgggtgttgatgtggtgaaagtagaagtcccgccggcgcacagagcattcgtgctgatgtttgtaaaagcgaccgcagtagtcgcagcgttgcacgctctgtatctcctgaatgagatgcgcttttcgcccgcgcaccagaaaccggagggggaagttgagactggggcttggtatatcgtg

SEQ ID NO: 33 - DNA, 513 bp, WUHARV Adenovirus 2 and 3 contig00078
gaaaggcaccttttacctcaaccacactttcaaaaaggtgtctattatgtttgactcctcggttagctggcccggcaacgaccgcctgctaacgcccaacgagttcgaaattaagcgttccgtggacggtgaagggtacaacgtggcccagagcaacatgaccaaggactggtttctaattcaaatgctcagtcactataatataggttaccagggcttctatgtgcccgagaactacaaggaccgcatgtactccttcttccgcaacttccaaccaatgagccggcaggtggtagataccgtgacttatacagactacaaagatgtcaagctcccctaccaacacaacaactcagggttcgtgggctacatgggacccaccatgcgagagggacaggcctacccggccaactatccctaccccctgatcggagagactgccgtacccagcctcacgcagaaaaagttcctctgcgaccgggtgatgtggaggatacccttctctggcaactt

SEQ ID NO: 34 - DNA, 500 bp, WUHARV Adenovirus 2 and 3 contig00078
cgcactaggaggagaggattctgcgatacgtgcagcagtccgtgagcctgtacttgatgcgcgagggcgccaccgcttccacggctttagacatgacggctcggaacatggaaccgtccttttactccgcccaccggccgttcattaaccgtctgatggactacttccatcgtgcggccgccatgaacggggagtacttcaccaatgccatcctgaatccgcattggatgcccccgtccggcttctacaccggggagtttgacctgcccgaagccgacgacggctttctgtgggacgacgtgtccgatagcattttcacgccggctaatcgccgattccagaagaaggagggcggagacgagctccccctctccagcgtggaagcggcctcaaggggagagagtccctttcccagtctgtcttctgccagtagcggtcgggtaacgcgcccgcggttgccgggggagagcgactacctgaacgaccccttgctggaaaat

SEQ ID NO: 35 - DNA, 451 bp, WUHARV Adenovirus 2 and 3 contig00098
caccgtctgcctgaaactcttaccgccacgggtttaataatgccatctggaaccacagcccccaaagtgcaaggagaattagcagaccctgatctatctccgtccccttccgcgtcagacacgtcacctgtaaaacattacacaaacaataagcccaacacactttaaaaatcccaccaccatgcacaaagcgaaaaagtttctacttactgtatacacaatggctggtaaggcgcaggtaacacagagcacatagagtctcgggatttccactggcatttctatgaaaatcacaggcgcggcaaccgtgaccaggattatcaggacagtctaatacaagttcattttttcacaacaggttcagcacagccatctccccctgtctgttccgtttcagaatcgctagaaggtagacattcctcgtagcacttcaggtccacttccactccct

SEQ ID NO: 36 - DNA, 427 bp, WUHARV Adenovirus 2 and 3 contig00110
tcttcttgttctaaattccattggttttccccaatttgtggctcgggttggtacactttgtttgcatattggggtgtttgtcctgactctgtcacaactagcccaacctgaataccatcctttgtaagtccttgactctggtagggagcctgagcatatgctttaagtttgttgtcggaagtgtccgtccattccgaggggttgggagctcccttgggggccagggagttgtaagcggtgccggaatagggcttgaagctgggaccccgatccagcaccccccggatgtcaaagtaggtgctggccatgtccagcactcggttgtcccctacggccagcgtgtagcgcactttgtaagagtacgcggtgtcctcccggtctacgggcacaaagcgcagggtcagcctctgcgagcggtccgtggtca

SEQ ID NO: 37 - DNA, 399 bp, WUHARV Adenovirus 2 and 3 contig00126
acacggctggggcagagcgtgctgcactgcaccttgcaaggcgaggcgcggcgggactacgtgcgagactgcatctacctcttcctcaccctcacctggcagaccgccatgggcgtctggcagcagtgcttggaagagagaaacctcaaagagctagacaaactcctctgccgccagcggcgcgccctgtggtccggtttcagcgagcgcacggtcgccagcgctctggcggacatcatcttcccggagcgcctgatgaaaaccttgcaaaacggcctgccggatttcatcagtcaaagcattttgcaaaacttccgctcttttgttctggaacgctccgggatcttgcccgccatgagctgcgcgctaccttctgactttgtccccctctcctaccgc

SEQ ID NO: 38 - DNA, 388 bp, WUHARV Adenovirus 2 and 3 contig00136
cgtcattaggcatgacgggcagtggtcgccggcgggctttgcgcaggcgcatgaaaggcggaattttacccgccctgatacccataattgccgccgccatcggtgccatacccggcgttgcttcagtggcgttgcaagcagctcgtaataaataaacaaaggcttttgcacgtatgacctggccctgactattttatgcagaaagagcatggaagacatcaattttacgtcgctggctccgcggcacggctcgcggccgctcatgggcacctggaacgacatcggcaccagtcagctcaacgggggcgctttcaattgggggagcctttggagcggcattaaaaactttggctccacgattaaatcctacggcagcaaagcctggtta

SEQ ID NO: 39 - DNA, 312 bp, WUHARV Adenovirus 2 and 3 contig00172
agaatatagaaaaccacggagtggaagacgaactgccaaactattgttttcctctgggaggaatggtggtgactgacaattacaactctgtgacgcctcaaaatggaggcagtggaaatacatggcaggcagacaatactacatttagtcaaagaggagcgcagattggctccggaaacatgtttgccctgtgaaattaacctacaggccaacctctggcgcggcttcttgtattccaatattgggttgtatcttccagactctctgaaaatcacccccgacaacatcacgctgccagaaaacaaaaacact

SEQ ID NO: 40 - DNA, 311 bp, WUHARV Adenovirus 2 and 3 contig00175
agaacaggccacggcgtttgaaagcatgagtcaaagagtgtaatcaataaaacatttttattttacatcacgggcttctggcgtttttcttaaaaatcaaagggttcgggggatgggtcgtcgtgcccggtgggcagggacacgttacggtactgtaggcgagtactccagcggaactcgggaagcaccagcctaggtagaggcacttcttccaggttctgcttccaaaactgccgcaccaattgcagggctcccatcacgtcgggggcagagatcttgaagtcgcagttgggaccagagccgccggaccg

SEQ ID NO: 41 - DNA, 308 bp, WUHARV Adenovirus 2 and 3 contig00178
attaggtagtagtcgtttgttaggtaagtagagttaatgttacagttaggttttggaaaagaaatcacatgtagttgaaagtatgtattatgttcaatggaatctgaaaaaactttagcattataaacaccagcatcgctaggtttcagattgtacaagtgtaggctattgtttatgcaatgaaattgtagaggtgggtgaaaccattcctgttcttgaagtggtgagctttcacaaagcttaacccccgtaaaatatgaaggtatagttgtgtcgaaaatgccctgaaaaacatctaagtaccaagc

SEQ ID NO: 42 - DNA, 305 bp, WUHARV Adenovirus 2 and 3 contig00181
atctcttctatgccaagtgaatttgaaggaatatccagtggttacataattgtactggacttggaaaaaaattggcatagaaagattaccttgcaaacaagtgtaaccaacagtttggttttgcgcttgttctcctctccctctaggatatctacttgagttgggcatgaactctacagcattagtaacattagtgttggctgattgaccttgtctatatccccaggtagagtctcttcctagggtgccttgattatccaaagttggatagttaatacgtacgccattgtcattaaagtgcttca

SEQ ID NO: 43 - DNA, 255 bp, WUHARV Adenovirus 2 and 3 contig00217
taggccaggggtctccgtttgcgtttccatagcttccacggcggttgaagcggtggtgacggggatttgaatgtccaccgtttgcaccccaagaccgggggccacttccttaataggtctgacttttacatccggctctatgctggggtccactttcatcttctccaggacctctttcagcctctgccgtttagggaccatgagttggatggtgggatgcagatcttccatttctctcttaatccccctgttgct

SEQ ID NO: 44 - DNA, 248 bp, WUHARV Adenovirus 2 and 3 contig00224
cacgataggattcaaggggaggagtagcgtaggataagtgtgttgttattggtgacagttaacggcgggttagtctgcacgctctgggtgctttctaattgtccgttcgcggtaattgttaaccctcttccaagtgaaagggctagttttctctccatgtcaaaatacaggggtttagctattcgcaggcttaaaactccgggggggttttcctgaagaccgtcactgtttacaaacgggggtgatat

SEQ ID NO: 45 - DNA, 244 bp, WUHARV Adenovirus 2 and 3 contig00227
ggcggcagaggctgttgaaagttattaacaagaggatatcggggtaaatcttctgggggatgaagccatccaatttttaagtagaagtacagtttaacgccaatgcaggttgctacaaaaactaaaaccgctgtggctacgtaaagccaggcaataggggtttcaggcagtacatcgtaacaggtgtaaaaggaccaaggtttggtaaaagggcaatgacattttaccaaaccttggtcctttt

SEQ ID NO: 46 - DNA, 216 bp, WUHARV Adenovirus 2 and 3 contig00259
agagtgacgtagggtcagtgtgttgttgttggtaattatcaacggtgggttggtttgtacgctctgcgtactttctaattgtccggcggcggtaattgtcaaccctcttccaagtgaaagggctagttttctctccatgtcgaaatataggggtttagctattcgcagacttaaaacacctggggggttttcctgaagaccatcgctgtttacaaa

SEQ ID NO: 47 - DNA, 206 bp, WUHARV Adenovirus 2 and 3 contig00273
gatgttgtggagaagttccacgtggacaacgagagtagaggggcttttaagtttctgcccgaccagggagctgtgtaccgcaagatctgtcaaacttggttgaacgaggagcaccgcggcctgccgctgaccttcaccaaccagaagaccttcaccgagctgatgggcagattcctcatggcttacatggaagcatacacgggggt

SEQ ID NO: 48 - DNA, 171 bp, WUHARV Adenovirus 2 and 3 contig00295
cctgtctcggtcgttaaggactttgtgtatgttttccaaaacacggtacagatgggcttggatgttcaagtacatgggcatgaggccatcccgggggtggagataggaccactgaagagcgtcatgctccggggtggtgttgtaaatcacccagtcgtagcagggtatcta

SEQ ID NO: 49 - DNA, 164 bp, WUHARV Adenovirus 2 and 3 contig00300
acactaatatcaatgtcctgagagtcagtcatctccaccggtgagttgaaagtagctaacaacggagggagctcgcggaagaggatcaggaggcggcagaggctgttgaaagttattaacaagaggatatcggggtaaatcttctgggggatgaagccatccaa

SEQ ID NO: 50 - DNA, 158 bp, WUHARV Adenovirus 2 and 3 contig00306
tgccaactttttttcccatggcccacaacacggcctctaccctggaagccatgctgcgcaacgacaccaatgaccagtccttcaacgactacctgtgcgcggctaacatgctgtaccccatccccgccaacgccaccagcgtgcccatctctggtcct

SEQ ID NO: 51 - DNA, 147 bp, WUHARV Adenovirus 2 and 3 contig00311
tctttaagtagaagtacagtttaactccaatgcaggttgctgcaaaaactaaaaccgctgtggctacgtaaagccaggcaataggggtttcgggcaatacattataacaagtgtaaaaggaccagggtttggtaaaaggacatgaca

SEQ ID NO: 52 - DNA, 146 bp, WUHARV Adenovirus 2 and 3 contig00313
acccacactatgaatttactcactggagtgcccaacagcatgcttcatagcccacaggtcacccccacactgcgtcgcaaccaggaccagttgtacacttttctggaaaaacactctgcctactttcgccgccaccggcagcgcat

SEQ ID NO: 53 - DNA, 119 bp, WUHARV Adenovirus 2 and 3 contig00323
ggtggagcagatccatggagcgtaaccccaccatgaatctgctcaccggagtgcccaacagcatgcttcacagcccccaggtcgtccccaccctgcaccgtaaccagcaacacgcggag

SEQ ID NO: 54 - DNA, 100 bp, WUHARV Adenovirus 2 and 3 contig00328
ggagtggtgatgtgaagttaaatgtaagtttgttgtctgtgacgcggagcggactcgagtagcctagcactaagctattgtcagttaggtttaagggggg

SEQ ID NO: 55 - DNA, 255 bp, WUHARV Adenovirus 4 GZXIHWF02JYIJE
gatgtggaggagggagataagtcagtccatactagttctccttgcactttgggggctgtggttccagataatgttattaaacccgtggcggtcagagtatcaggcaggcggtgtgcagtcgaaaaaattgaagacttgctgcaggaagagcagatgcaacctttggacctgtccctcaaacgccctaagatgacctaagcctgtttattgagtgcaataaaactgttgatctttgaactgtgttatgtgttgggt

SEQ ID NO: 56 - DNA, 533 bp, WUHARV Adenovirus 4 GZXIHWF01BXOFZ
tagccgcctcgaacagacattcgggaaacatactatttaccgcgtcctcgttgggatctgccggaggatccacttccacatcgaaaaggtcgtgaagtgacggaggcgaagccacaggcgaattgggaatttccagcaaatctgaattcagcaggtcatctgagttccgcgccgcctcgtcgcaaaaaaacaccaaacatctcggggaccagcctcattgtggcagcgcggaggagaaaactctactcgccagcactcaagagtggcctcttgatgatctgacagcgtttaaatacccggcgaaaacgctgaggagtacaataaatgggacctttgagccttctcgtggtactgccacgtagcgaaacctccccgtcagcgcccaaagttcactgctgaacagcagaaattccgcccagtcataaaaagtacatattaacctcaacttcctcattacccagttttcgcgccaaattacacaaaacttacaagtatacgcccaaattacccatcttccggtataaaacctcctt

SEQ ID NO: 57 - DNA, 149 bp, WUHARV Adenovirus 5 contig00001
gtgaggccgtttcctattttcaacgtgagagatccattttgtgtagtaatgggatccttgtagtttaaacttaacactccaagtggtttttcctgcaacccatccgaggggtaaaaggtggagtaatgaagggcataacgggagcgtat

SEQ ID NO: 58 - DNA, 531 bp, WUHARV Adenovirus 5 contig00002
cagccgcctctaactgtaccgtttttaccaacggtgattctttactctgtttatgtttaaccaaatgtggagctcacgtgttaggaagtgtgagtttaaccggaatgcaaggaaccataacagccatgacacagaactacattagtattcaatttctatttgacaacaatggtgcgttgacttcatcaccgctcctcaacaacaacacttggggtatacggcaaaacgacacttcgtccgctaaccccgcctacaatgctcttgcatttatgcctaacagcactgtatatgtaagaggtcaaagtggtgagcccagaaataactattacacccaaacataccttagggaaacttaaaaagccaattatccttaccgttacctacaactcggctgcttcaggttattcactaacttttaaatgggatgctgtagtaacagaaaaatttgccactccaacatcttctttttgtatattacagaacaataaattcctattataccaccaattcgtttttttcagatgaaacggg

SEQ ID NO: 59 - DNA, 522 bp, WUHARV Adenovirus 5 contig00003
cttgcactagcctatagcgaaccattagcagtaaaaagcaaccgctaactttatcacacaccgccccccttgtcgttgctaatgattctttagcgttgcaagtttcagaacctatttttataaatgacgatgacaagctagccctgcagacagccgccccccttgtaactaacgctggcacccttcgcttacagagcgccgcccctttaggattggttgaaaatactcttagactgctgttttctaaacccttgtatttgcaaaatgattttcttgcattaggcattgaacgcccctggctatagcagccgcaggtactctagcactacaactcactcctccattaaagactaacgatgacgggctgacactatccacagtcgagccattaactgtaaaaacggaaacctaggcttgcaaatatctcgccctttggttgttcaaaacagcagcctttcgcttgctattacccccccgctgcgtctatttaacagcgaccccgttcttggtttgggctttact

SEQ ID NO: 60 - DNA, 260 bp, WUHARV Adenovirus 5 contig00004
atctgccctggaaggatactcccttaagttcacctggcgcgttgtagccaaccaagcttttgatattccttgctgttccttttcatacatcacagaataaaccactttttaaaattttcttttattttacacgcacagtaaggcttcctcccccttccatttgcagcatacaccagcctctcccccttcatggcagtaaactgtggagccagtccggtatttgggagttaaaatccaaacagtctctttggtgatgaaac

SEQ ID NO: 61 - DNA, 211 bp, WUHARV Adenovirus 5 contig00005
tggaggggtggtttgcacgttctgtgtgctttctagctgtccggtggaagtaattgccaatcctcttccaagtgaagcgcttagtttcctttccatgtcaaaatacaagggtttagctattcgtaaacttaagactccaggagggttttcctgaagaccatcgctgtttacaaacgggggatataaaggggaccgcaggagtggatgtgga

SEQ ID NO: 62 - DNA, 265 bp, WUHARV Adenovirus 5 contig00006
ttcttttcatctatgaaaagatgaaaattgtgggtaaggacaaggaagtggatattaatatttgttttagggtttggaggaagtttgccgcccaccatcacgtcccatacgagagttgggaagagggtaaagtggtgctgctgaatgatgttaccaaaaaactgctgtcaaatttaaggtaagtttattgatactgacttacattttaaatatatcacctaaggcacagagagttctaattagtttgggcatacaatcaggcgcg

SEQ ID NO: 63 - DNA, 1097 bp, WUHARV Adenovirus 5 contig00007
taaagatctccgacaaaattatacagttgaatatccatttaatgaattatgtacagatataattgctcttgaaacagggtcgattttatgccaattttatagttaccctagtggtgagcattatagttattgtgatgggtatcacatatcttatttatcacttaggactttaaagaccaaaaccaaaaccaaaaccaagcctcctgaaatccgtttgctttaatttttccagaatggtagctgctttcttcattttctctgtataccaatcatctgcgcctccacaacttttgccgctgtttcccacctggaaccagactgtctaccaccttttgttgtatacctaatactgacttttgtggtctgtacagccattaccagcatagcctgcttttttgtaacaattttccaagccgccgattatctctacgtacggtttgcttattttagacatcaccccgagtatcggaatcaaaacgtagcttctttactttgtctagcatgattcgcctatttatactgcacactctgtttaccctcgcaaaatgtcattgcccttttaccaaaccttggtccttttacacctgttacgatgtactgcctgaaacccctattgcctggctttacgtagccacagcggttttagttttgtagcaacctgcattggcgttaaactgtacttctacttaaaaattggatggcttcatccccagaagatttaccccgatatcctctgttaataactttcaacagcctctgccgcctcctgatcctcttccgcgagctccctccgttgttagctactttcaactcaccggtggagatgactgactctcaggacattgatattagtgtggaaagaatagccgctcagcgtcagcgagaaactcgggtgctggagtactttgaactacagcagcttaaagagtcccactggtgtgagaaaggagtgctgtgtcatgttaagcaggcagccctttcttacgatgtcagccttcagggacatgaactgtcttacactttgccttcgcaaaaacaaaccttctgcaccatgatgggctctacctccatcacaatcacccaacaaacgggacctg

SEQ ID NO: 64 - DNA, 276 bp, WUHARV Adenovirus 5 contig00008
ttaaacccgtggcggtcagagtctcaggcagacggtgcgcagttgaaaaattgaagacttgctgcaggaagaacagacgcaacctttggacctgtccatgaaacgccctaagctgacttaagtgtgtttattgtatgcaataaaagtgttgatctttgaactgtgtttatgtgttgggtgtgtctgtgggtatataagcaggtggatgggaagtgagagcacagctgcttcagatggatctgctaggagacctgagaggatttggcgtggtgcggc

SEQ ID NO: 65 - DNA, 445 bp, WUHARV Adenovirus 5 contig00009
gcagccctgatctatcccgacacactggaggtggaggaagacacggaagaggcatgttattccaagcgattcaccaacgggtcgaaatgaagatcccgaagatgacaacggtcgcctccggagccctgatggaatttaacagccagatcaaacattatgcgattttccaggctatcaatcgcggcctccaaaagagcctggacccgcacttccacaaacaccagcaaagcaaaagcgttattatcaaactcttcgatcatcaagctgcaagactgtacaatgcccaggtaattttcatttctccactcgcgaatgatgttgcggcaaatagtctgaaggttcatgccgtgcatattaaaagctccgaaagggcgccctctatagccatgcgtagacacaccatcatgactgcaagatatcgggctcctgagacacctgcagcaga

SEQ ID NO: 66 - DNA, 464 bp, WUHARV Adenovirus 5 contig00010
gtttggtagttcgtcctctactccgtgattttccacaattctaacatctggatcataactatctacggcttgattccacatagaaaagtagcgacttctgtctcccagtgcatccaacatcagctggtaggatagttccgtatttctatcttgcaaatctactaccgcatttagctgcgaagcctgaccggcaagcacccccatgtttcccgtgctgttgtaatacattagtccaataaaattgtccctaaaagcaatgtaatttggacggtttggagcggcttgttgcgctagcaaagcttcggcacttgtcgttccctctgtcacagtgggtttaaacaccaagtgcgtatcgggaccttctaagttaacatcttcagcataaagaacagcttttggcgttgtattggctgcagtggtggcaaaaactgcatatccacttgggtgtcagccttcgcctgccc

SEQ ID NO: 67 - DNA, 373 bp, WUHARV Adenovirus 5 contig00011
ggtttgtagtgtgtatcctcccggaggccgagagggatctgtgtggattacaagagtggctgcattttgcattgagaacagagcgcgcgcgacgcagggaccggcgttacgtggatacctgttggcagcggacgtggttctgctaccacaagtaccaggaggtgcgtcggtctctggtctacgatgcagcgcgacagacggtatcgttgcagactggctccttacgatcgtcaccagctaccaccttgtgaggaccgcagcagtgctgttgtagaggagaactctcggtacttagaatgtgaaaatatgaacatgcacaatgttagtgaggtgaggagtataccatcttgtattagctttattgtactgcagg

SEQ ID NO: 68 - DNA, 267 bp, WUHARV Adenovirus 5 contig00012
aaggagccaaactcaggaagaacagcagaattaaaaaagacttggcagagcgagccgttcgcgaaccactgaattagttcgttagtgcaggagcagttaagggtgagaagagtagtagagttgtaaaaataaacagtttctcgtatacctctgactgaagagctgtcgacaacttttggagaaacgacgcgtggcgttgaaggtgcggcaaaaagttcagtttttattaaactgagcgcaaagatgacaacacagatcttcatgtaa

SEQ ID NO: 69 - DNA, 354 bp, WUHARV Adenovirus 5 contig00013
tccgccacagaaaaaaagcgtcccagatacccagcgggaatatccaacgacagctgcaaagacagcaaaacaatccctctgggagcaatcacaaaatcctccggtgaaaaagcacatacatattagaataaccctgctgctggggcaaaaaggcccgtcgtcccagcaaatgcacataaatatgttcatcagccattgccccgtcttaccgcgtaaacagccacgaaaaattcgagctaaaatccacccaacagcctatagctatatatacactccgcccaatgacgctaataccgcaccacccaccgccaaagttcacccacacccacgaaacccgcgaaaatccagcgggtg

SEQ ID NO: 70 - DNA, 6578 bp, WUHARV Calicivirus 1 contig00005
ggtgccttgtaatccatgtaagaaccccaagtggagtattttgacagggaattacttgatgtagttgatagagaagaacttgtagagatagtggatggcctcctagacaggcccacagaagaattgatagaaagagagtcatagtttagaggattgttcacccaattgtagactgtaggagttctagattttgattttgacgccttaacagcatcatacatggttttaatccctgatgaaagctgcatgccagaagataagtagccagtggggttattagcagcataagttttgacaccagcatgagtcaacactcgagtgggcagaacactactcggggaacttttagataagagtgcagcatcagaggcagaaaaaccagcattcaggtatttagataaatcaagttgttgattataggctgagagatctttagaaatttcaccctgctgttttgcaagttctagattgtaaccatgctgctgttcagcaagctgcctgttgtggctaaactgttgctcatttaagccagcttgtatagctcctgatatgagagatccgaaaatccctcctgcagcttggccaaggccacttgcgaaagcggcaccagccattatctgaagctaagggtagcagttgtgttcaaatccaccacagaagcaatattgaaagaaggagaaacccaggagttaaatctaaaagttccatcaggtgggatcaccaatccaccgttacctgcagcgttggcagtgagatacccttcggggtacatcttgaattgccgcaccacagatccaccatataggacataatctaacagagcaactttaccttctggaaagccacttgcatatgcagagcggatgaggtcaggggacataagagagcagacattcacaggaacagaattcacacgatctgctgttttggaagcagggacagatgacctaaaccagacaaattgttcacccaatggggggctaatagttggggcataagaccaagacccatagcacttcggagcaacctggactgtatcgtcgttggctgcgccggaaacacccatgggtataatgatgtattgtttgttagcttggagtgtagagtcaatcacatatatctgtctctggtaggtgtcatcaaggccaacggttttgttgtctccaaagtcgaacatgtgggcatcgacatccttgaaaccgccatcaaccttgactccagtaaaacagacaaggtgttgcttgtctccagccctaactccagagccccagtcacagaaaccccggggaaggggtgggagagagggatcttgagtgggattgtcaggattgtcaataagtgccacgtgccaatctgtattgccaggtacagatccagcttcagctgtgtatgtggccatccatgcgccggcagggttgaatgttgagttcccaatggcaccggcggtgatgtcatatctgccgagttggtggttacatgtattgtattttgggtctacatacaactcaacaatgggggtcataggactcctaggattgatcatactgtacggaggtgcaggtggtacattccaaatagggagtgcagtgctttgggttggaggtacaagcatggtgaatttgaagtcagggagaggtgcagcagtgagtttcacctcaatgtcaaagtcagtatttgttgaacgaagtggggaatacaccatgatgaccagtttggccagtttgtcaccacggaaatggtaactcacatttttgatgtcaggtgcaatgatctccagggagtcagcagttctgaaatctaggatctcatgaggaaaggcagtaagcatataagcagattgtggaactggaatgtttggaggaatgacagcagcaatcagcttcccagcagtgaacgcattgcccgctactagcagcttgagggtgaacccacctgaccagccagcatacatgcgaaacatgtgtgatgtatagatgttcagttcaggggagatttcaagttcaaggagtgttgtgccgggttgagttgaactcgccacagtgaaagttccaccagggacttcagtggggttaaggaaaatccatggatctatgggattgattgtaggggctagggagagatctgaagaagcttcaggcaaaggggcagcaacagagtttatggtaacaccggtagcaccggtgacctcagtagtctcagtcttggtagtgggctccatgactcacacaaaaccagaacaaccaatatcattttgagtggcccacatgaaggtgggccagaaaggccatggctcaaatttgacatgtgccaaacatgctgcacgcgcgcacttgtcacgcatgacgttgaagtaggcctcaccatgaagtgaagcctctcccatgacacacatcagctgctctccaaaccatggtccagggtagccaatctctagtgggttgttgtgttgtggtccacgtgtgaggtagagttggcgttcaatggatgactttttcagtgcgccaacacatctgcctccaacgtagtttgttgtgcgggacaaaaattccatcttggacttgtggacaggatgaaagaattcagatttgtctggatttgtcgggtggaaccccatccggcgcatctcattagcatacctcacagcaaaatttgaacatggacaattaataacttcatcatcaccatagacagcgaggggccaattgactgcctcagcgatggatatctttgcagcatatgcaacagcaatggtggtagcaatccagtgacaaacacaattgaggagtgaagtggtcgggatgccagagggtaacccttggtatacagttctgagttcatcattaacgattactttcctgggttggcacaataagtcaatgagttcaggtgctttggggtggtctgagaggccaaacagagtttttactcccatttcataaattgactgtatcattgttgagtcccatctactataatcaacacacaacacatttggtccaaatgattgatcaagaaaccaccactctactgtgggattcatacctaccttgccgggccaatctccgcgcatgattttcagttgcgaggcaatatctgtcatcagtgcagcacatgcaagggatgtttccaaaggggcacaccaaagaaggcgtttcttcccttcatctaatttggactgtttgacaggctcatctttgagtgctgcagtgtatatgggccggtggagtttaaccttcccatccagccatccttggacacggtcaattgttgcctgaacaccaggtaaggatctatcctttttgcagtagaggggataccctgatgatgtggtggggtcaagagtttcaaatgcattttcagcagaaagtgtaatgcgtgtgcgtatcagtccttgcaatttgacacgcacagcatctgccgcagcgatcaaatcagcttggttaacccgcccagcatttgggatggtgtagggtttaaacatttcctctagtattctgctggttggggttgggtttctggggtcctttgtacccacaagaggtgggtgcatctcagcttctacctcttcagaatattttgtgtaccaaatctgggttgtctcaggggggattttctttggaacaaatgtggttttgccttccagattgaagcgtgtggggatgactagccctgccacttggtttgtgctgaagctacctgctgtgtgaattccaattaaggttggtttaccgttgacaaatttgatgtagggtgaaccacagtctccaggttctgatcctaaaccatcagactttttgccagctgcgacaacagtgccagtgaagacgttgaggaatttgcccgcaatgttggtgttgccaatactgcggacaatcactggaatgtttggcctttgggaacctctagctgggcataggtttaccacttcacctgttgttggaaatgagatgtccaactttccctgggacttaacaccaggaacatccactaggcacagttcgccgtccattttgatgatcttgaacggcatgcctcgaattttgtcacaggttttagcaacatgggtggcagtaagaaataagctcccactcacctgggttgcacaccctttcttgacaccatcagaggttgctggatagacaaaggaacacacatagccctcatcatagtagtcatcagcaggggcgtagtcaagattgtgtctctgtttgaaatcaccatcaggatcccaccattcctcttcttcaccctcagagttggcgccaatgtcatcaagaaagtcatcaactgtgtagacaatgcctctccctgcagcttcatcacgtctcttcaagaactcattgtactcctggggggaaaacttatatctttttgaaaccttactcctcagtttgcgggcacccctaccctttttattcttacctttggcttcaaacaccgccatgctggctgcggtgtcatttgagtcttgaactgcatttgcttttaggaagaatgtgaccaattttgtgagtagccagtggagggagacaccaagcttccactcgttgagtcgagtggcatagggtgtcgggtctatcttgatctcagcccctgaatcacagtcatagtagacttcattactcatctttttgtcaccatgctcaattgtgccagtaaggaatccatccagagaatacagatctagtttgtagcccatgacagtgcatttgatgtctccgccagtgtaggcgatgcgggggatgacacctcgccgcaagtcattcacgtgcctaaggccagcaaagtaagagcaccccaactggagcataagccaaccaacagtctgttcagggtattcatcagactgcattttccagacagcaagtgtgttcacctggacagtgtttggtgaaacaggttggggcttccattggccgaagagtgaagctccatggaaatttgttgcaaattttgggagttgtttaatggtcaagtgactaaagtcatctttgtatggttttggcccattgcagccgcctttttgccagtgttccacagcaaaagacgtaacatgatagtggaagtctacacggcgtagggtggccatgcgacagttgccactagagatgtcttccaaattggtagtgaggatgatgacagttgatgtgaaaaactttcctttgttttcaagacggtcacagtttagtgtgacaggcatggtgtcagcaaggcgttggaacagtttcctctcttcctcggcattggttgcgccaaaatcctcccagatcatcaccccttggttatcgtatgcatcccaatggtcaacacctggagtgtgactatacacgccagtcttgagctccttggcacaatgtgtggctagatgtttagcaaaggtggtcttaccacatccaggtgggccggctaagacaacaacaattggcctacgccggtgggctgtgttcatcattgtcttctccaaggctttcttaacatcctgtgcttgcttgattgcttgagcaatctcagggggtgcagaggggtcacaagccatgacactcaggtctttaattgtgtcactcaacttttggatgcgtgttgacgcatcatcacctgtctgaactctcccgtgggacaaatcttcaaggacttctgagatggattcttgatgtggcttccaagggggaacggtgccagtgatagtctccagcacacgcacaccaaactcagaatgtgttccaaactctgtccaattctggataaatttgttgaagttcctcaaaactgatgaaaaagcattcaatgacttcttgaaaatgaaggacgtgcaaaaacccatagcgcccaaaaccaacttcattaagaaagatggggaaaatggcgactgtgggagcagtgatgaggtaagaaaagtgatcaatttagagatgttgacgccccacaattcggcaacacgcgtgaggaatgcgagcacaccgcggaatgtgggtttcattgtttgccaattatgccaaaggtttaggggtttaaaatccatacatatctttgcccaatcaacatctttgataattaggtacacgatctcgaggagttgttgtgtccacccacttttggtccctccgacatcgtacctgttctcattccaatcctgtacatgtgtgtagaatgtggttggtagtggtttatccttgtagtgcacatatgatactccaatcacttgaagtatagcgtgcagacagtttgatcttgtcagggagtaagggaacttctccccaatttttgagtcataaaaagatttgtccccagggccatataagtcaagtgtgccccaagggtgagtcaagccattgtatcggaaagcaccgttcccgatcatgcctcctgttgaaaataggaggcccctctcgacgtatactgcatagtgaaagcagtcaccttcgtcgagcacaatgacttgcccaatttttggttcaggcctcctatcgtaggagaccttgcttgtgtttccaaaaataagtttttggatgtccgccccacatatggggctggactctgataacacagaatctatggacttatccatagctctagttacc

SEQ ID NO: 71 - DNA, 812 bp, WUHARV Calicivirus 2_contig00010
ggccctgaggacaaaactttctatcaaaacaagattggagagaaatacccctactcaatcacaagaagcaattgcctgcactcaattttgcaaaccattggggtgtcatatgtgcattataaagataaacccttaccagcccagttctacacacatgtccaggattggaatgaaaacaggtacgacgtcggagggaccaaaagcggatggacacaacaactcctcgagatcgtgtaccttattgtcaaggatgttaactgggcaaaaatttgcatggactttaaaccattaaatctttggcacaattggaaaaccatgaaaccaacatttaagggtgtgttagcatttttaacaagagttgctgaactttggggcataaacatatccagtttggtcacatttcttacctcatcactgatcccacagtcaccattttccccatccttcttaatgaaggtggttttgggtgccttgggtttttgcacttcatatatcttcaagaaatctttgaatgctttttcttcagtgttacgaaactttaacaagttcattcagaattggaccgaatttggcacacactctgagtttggtgtgcgcatccttgagacaataacaggcacaatacccccatggaaaccccaccaggaatcaatatctgaagttctggatgacctcacacacggcaaagttcagacaggtgatgacgtttccacccggcttcaaaagttgagtgacacaatcaaagatctgagtgtcatggcttgtgacccctctgcaccgcccgaagttgcgcaagctataaaacaggcaaa

SEQ ID NO: 72 - DNA, 5083 bp, WUHARV Calicivirus 2_contig00011
ggggatctagacaaagttggggctttggaactagcttgagaaccaattgataaagtgtcataatttaaaggattattcacccacttgtaaactgttggggtttttgatgacttagcagagagagcagagtacatggtttgtatcccacttgagatttgccttccagatgttaagtatgaagtgggcgccccgctggcgtacaccttgacacccgcagaagtgagcacacgagttggtgataggcctgaggaaagagacttggacagcatagcagcatccgcagaggagaagcctgcattggtgtactttgaaagctcaagttgttgattgaattgatttatatcctttgtcagagtggcattttgttgtgccaactgaagattataaccaaattgttgctcagccaaggctttattatgattgaactgttgctcattaaggccagcttggacggcaccagaaattagtgacccaaggatgccaccagaggcctgacccagacctgaagcaaatgcagctccagccattatctaaagacaactgctgtctgcacgttcaaatcaaccacagaagagatcacaaaggatggagaaacccaggaattaaatctaaaataaccatcaggaggaatgacaaacccagtatttgacccagtggtgttagcagtcatgtacccctcaggatacaatttgaactgccggacaacactaccaccaaaaagaacatagtcaagaagtgcaactttaccaaggggaaaccagaggcataagcactgcgtatgaggtcaggtgacattagggcattgacattaactgggacagaattgacaccactggaagttgtggtttttgaagcaggtagctgagacctgaaccaaacaaactgctcaccaagtggggggggctacaactggagcatagtcccaggaaccataacagttgggtgccacttgtacagtgtcatcatttgctctccctgaaacacccataggtattattaggtactgggagtctttttcaagagtggtgtcactaatgtagatggacctttggtaggtgttgtccaaccctacagttgcattatctccgtagtcccacatgtgtgcatcaacattttgaaacccaccttcaactttcttgcctgtgaaacacaccaaatgttgttgatctcctgatctgatgccagaaccccagtcacagaacccgcgtggaacaggaggcagtgtgggatcaagcgttgggttgtcgggtagatcaagaagagcacacctccactcaggatggtcgattacggagccggcttctgctgtgtatgtggcggtccaagcaccagctgggttgaaggtggaagtgccaatggccccttgagagatggtatatcttcccagttgatggttacatgtcgtatagctggaatttatgtacagctccacaactggagtaagcggacttctggggttgaccatgctgtaaggtggagcttgtggtatagaccagattggcattgcattgttttggatgggcggaacaagcattgtgaatttgaagtcaggaaggggtgccgaggtgagcttgatttcgatctcaaagtcagttgcagtcgacctcaacggtgaatacaccataacaaccaatttacctaacttgtcacccctaaagtggtagtcaatgtttttgatgtcaggtgcaatgatctccatggaatcagctgtcctaaagtcaaggatttcatgagggaaaccagtgaggaggtaagcagagtttggcacctcaatattgggtggtatgatagccgcaatgagtttgcctgcagagaaagcattacctgccacaaggagcttaagtgaaaagccaccagaccaaccagcatacatgcgaaacagatgggatgtgtaaagattgagctcaggggaaatttcaagttctaacaaaatagtcccaggttgtgtggcactggcaacagtgaaagttccaccgggcacctcggtgtgattaagatagatccaagggtccaatgtattcacagtaggggctaaagagagtgaagaaacagcttcaggaaggggagctgaaacagtgctttgggagatgccagtggcaccagttacctgttcagtcttgttgctttccatgtctaagatgattgtgaccaatcacaagaattcagaacaaccaatatcattttgtgtggcccacagaaaggtgggccagaagggccaaggttcaaatttgacatgagctaagtgtgctgcgcgagcgcatttgtctttgatttcattgaagtactgttcaccgtggagtgacgcctctcccatgacacacatgagctgctcaccaaaccacggccctggaaagccaatttctaagggatcactatgttgtggccctcgggtgaggtacagttggcgctctattgatgttttcttcagtgccccaacacacctaccacccacatattgagtcgtgcgggacaggaactccattttggacttgtgaatggggtggaaaaattctgatttgtcagggtttgtcgggtggaaccccatccgacgcatctcatttgcatacctcactgcaaaattagagcagggacagttgataacctcatcatccccatacacagcaagtggccaattaacagcttcagcaataggaattttcgccgcataagcgatagctatggtgctagctatccagtggcacacacaatttagcagtgatgttgtgggtattccagagggggagggccttgatagacagttctaatttcatcattaacaataactttgcgtggctgacacaacaagtcaatcaactctgaggctttggggtgttttgaaagtccaaaaagtgttttgacaccaatctcgtaaatcgattgtatcatggttgaatcccacctgctataatcaacacagagaacgtttgggccaaattgttgatcaaggaaccaccactccacagttgggttcatcccgaccttgccaggccactcacccctcatgattttgagctgggcacagatatcagtcatgagggcagcgcaagcaatggaggtttcgagtggtgcacaccacaacaggcgctttttcccttcatcaattttggattgcttgacaggttcatctttgagtgcagctgtgtatatgggtctatggagttgtcctttaccatcaagccagttttgaacccttttaattgttgactcaactcctggaagtgacttgtccttcttacaatatagggggtagcctgatgaggttgatgggtcaagtgtctcaaacgcctcctcagcagataagtccattcgtgtcttcacaagtgcactgagtttgacacgaacggcctctgcagctgcaagtaaatctgcctgattcacccttcctgggtttgggattgtgtagggcttgaacatttcattgaggatttcactggttggcatggggttccttggatctttggttcccacaagcggtgggtgcatctcaacattgacttcctcagaatatttggtgtaccaaatctgagtagtttcaggtggagttttattggggacataggttgtttttccttcgaggttgaatttggaaggtatcaccaaacctgcaacctggttggtggtgtaactgcctgctgtgtgaatgcctacaagagtgggtttcccattgacaaatttgaggtatggtgagccacaatctcccggctcggatcctaaaccatcagatttcttcccagctgctacaactgtacctgtgaagacgtttaggaatttcccagcaatgttcgtgttcccaatgctgcgtacaaccacagggatgtttggcctttgggatccccttgagggacacaagttgacaacgtcaccgatggcaggaaatgagatttcaagcttggtttgggatttaacaccaggaacatcaaccagacataattcaccatccattttgataatcttgaacgggagaccccgaattttgtcacatgttttggcaacgtgtgtggctgtgaggaacttgctgccactgatctgcgtagcacagcctttcttaacccccaccagaggttgcagggaagacgaaagcacacacatatccctcatcataatagtcatcactgggttcatagctgatgtcatgcttttgtttgaattcaccatcggggtcccaccactcctcatcttcttcatcagagttgtagccaatatcatctagatagtcatcaactgtgtacactatgcctcgttgagcagcatcctctcttcttttaaggaattcattgtattcctgtggggagaacttgtagcggcgggacacctttgctttgagtttgcgcgctcctcgaccctttttggatttgcccttagcctcaaacacaccaagtgcttgcgccgtgtcattggaatcttgaacggcgtttgctttaaggaaaaagttaagtaacttggtcagcaaccagtgaagggacactcccattttccattcattgaggcgaatgtcgtatggtgtagaatcgactttcacctcatgcccggtctcacagtcgtagaatatctcattggacactttaacatcccctttctccactgtgccagtgagatatccatcaagggagtatagatctagtttgtatcccatcacggtgcatttgatatccccccctgtgtatgcaatacggggtatgactcctctgcgaaggtcattcacatgcctgaggccggcaaagtaggagcaccccaactggagcatgagccacccaacgggcttctctgggtattcatctgattgcattttccacacagcaagagtgttggctttaacagtattgggtgatacaggctgcgggttccactgcccaaatagagtgtttccatggaaatttgttgcaaatttgggtaattgcctaatggtgaggtggctgaagtcatctttatatggctttggtccattacagcctcctttctgccagtgctcaaccgcgaaagatgagacatggtagtggaaatcaaccctacggagtgttgccatgcgagcattcccgcttgaaatgtcttccaaatttgtagtcaaaatcattatggtggatgt

SEQ ID NO: 73 - DNA, 2111 bp, WUHARV Calicivirus 3 contig00040
ttgctggttcttgacaaaaattccatgtgccttttatgtacagggtagaaattgggggatttgtcaggattggttgggtgaaagcccatacgagacatcgcccgagtgtatctgcgagcaaatacctctgatgggcactcaatgacctcatcatcaccatacaccgccaaaggaaaagtcacggcttctgcacacgagatgcgcagagcttgagatatagcaatggtcgaggctatccaatggcatatgcagtttagaatagaagtagctgggacaccagagggaagaccttgcatcactgtcttaatttcatcaacaatcaaaactttcctgggaagtgtcaagagatcacgcaaattatcagctcggggatgatctgagagagagaagagaactcttaaaccagaagcatagatgtcatttatcattgtactatcccacctagagtaatccacacataggatgtgttgaccaaacattctatctaagaagggccactcagtgttgcagttcattccaactttacctggccaagaccaccggttgattttcagtttcgcgcaagcgtcagtcaagattgcagcgcaagctattgacgtttcaaggggtgcacaccaaagaagcctgcgctgagggtcatcaatcttggtctgcttgacaggttcatccttcaatgcggcagtgaagatgggctggtgtatatcccctcttccatctagccatgcttgcactcgctcaatggtggctcgaaccccactgatttccttgtctttcttacagtagagtggataccctgatgacgtgtttggatcaagggtttcaaatgcctcctcggcggacagtgtcagagacttcccagtaatggacctgagtatgccaccgactgcagcttcagcaaaagccaaatcaacctgattaactcttccagggttgggtgtgaagtaaggctggaccattttctttacaatatcatccagtgatgtggcattgcgagggtcttttctccctgtcaaaggagggtgttggctaacttccatctcctcactcatcttagtgtaccatatttgtgttgactctggctggtgtctaggcttgaccttcactccaccttccaagttccattgatttgggatggagatggcagcgacttggccagtggtggcactgccagcggtatgaatgccaataatgtggggggtgccattgattatcttaacatatggggcaccacagtccccgggttcagatcctaatccatcactcttaatgttggatgccacaacttttcctataaacccattgatgtatctgccacagataaagttgttgccaattgatgtcactttaacgggaatgtttggcttttccgtgggcctatgggggcatagaactagcacctcaccttccacagcttgcttgattgggacaggttttccttttacacctttgacctgcaggtagcacagctcaccaacagttttgactatggtgaatggcttacctgcaatgttgtcacaagcattggccacatgtgttgcagtgacaaacacgtcccccttcactctagttgcacaacccatgtgattgtgtccagcttgtgctgggtacacaaatgagcagctgaacccttcccaaccaaagtcccttgcatccggggcatcattcattgcatcatacatgtcatcatcaagatctgactcagcaccaatatcatctagatagtcctgcactgtgtaggccacaccacgagactttgcatcgtcccttctcttcacaaactcatcatattcttctggggaaaatttgtaaccaatcctggccttcttgtgtctagcacctctgcccttctttgtcttccccttggcctcttgctccagtgatttggcaagctcaatcctgccttgggtctttgagctgtccttcaccgtgatcatgccgattgcccaaccaagtattttcctgaagaaagaccagaaagaaaaaccagtaacccaattttttagagaacacacttgggatggaaggtcaaccatcccagtgccacagtcatagaagacctcatttgacacctcatttccatccttgctgattgttcctgttagcactccatc

SEQ ID NO: 74 - DNA, 1273 bp, WUHARV Calicivirus 3 contig00102
tggggtcatgacttttgttgggttaacaccagcacttcttgtgttaagcaggactgcatcagagggtgaaaagccagctttagtgtatgctcccaaagccaagttttgattatactcagccaattctttagattgttttgttcccaaatcatattgcaaagctgtcaactgcttctgaatctggccctccttctctaacagtttcatgttgttttgaaactgttgctcctgtgcagcccatgttgccaaggagttgaggccaaaggacagaacacctgcagcaatctccatcagtagaattgcacaacctggctagcaaaagaaattgtgccagccacttggtaagctctagaaacccatgcattgaacctaaagtagccattagaagggataacactgccgccattgccgctggtggaggttgtcagcataccctccgggtacagcttcatttggataacttgagatccaccaaagagcacatagtcaagcagcgcacactgatcagatggaaaatttgcagagagaccagacaggtacagttcaggggttaacaaactacagacatgaaaagggttcccagagacgatagaaccgtccacagtaaaagatggaacatatgatctgaaccaaactatggattcgccagctggcggggtgatggttggtgcagcgtatgggccgatagcatcgggtgcttcctgaaccatagcatctgtgaccttagtatccacaccaacaggcatgaggattccagttttattggagatgtcaacattgcctgttgcagttggttgtcttagcatgatgtattgctggtacttgtcatgccagacgtctgtaccatctccatcttgtccccagtcccaccaaacagttgctgcgtttccatatttgtactctgtgtctgtagactcagtccataacgcaaccaggcgctgcgatccatggccagacgcccaatcacacattccccttgggacaagttgggaaactgaagaagagtaggttggattgtcaggattttgtatcacaccattgtagaacccgtggtggccggttgtgtcggtgttggtcttaacactaaccatccaagaccctgcagggttaatcacggaattcccaattacaccattcacaaaggaatatctacccagttgatgattgcaagtgctgtagccagaatcaatatagagatcagaaatcttcgtcaaaggagatcgtggattcaccatggcagatggaggcacttttggtatggtccaaataggca

SEQ ID NO: 75 - DNA, 832 bp, WUHARV Calicivirus 3 contig00204
tacaatgatgttctagagaaagcactgacggcagcccatttggcggaagttcagttaaatccttggccttattgggctgtgtttcaatgggccatttcatgtccatttgaggaacatcagggtgctgagacccttgaatctagggtttgtgcgtctgaagtcttcttggctctccctttaggacacaactatagctgtgatggctgcatcaaaggaaacaagctctgtaaccaccgaatcagtgactggtggaacaggagaagtccaacagactgccgaagtgttgctgccagaggcagtcagttcaatgagtcttgccccaactagaaactccattgacccctggattttcctaaaccctgctgaagctcctggcactgcaaccaccttcagtgctgcaactcccgctggaacgaccctaattgatgtggaaatatcacctgacctaaacatgtatctttcgcatatgtggaagatgtatgctggttggtcgggaggattcaaaattgaacttgttgtggctgggaatgcatttgcagctggtaagatcatagctgccattattccacccaatgtccaagtcccagaaaccccttatggcttgacaggatttccccattccattttagatgtcagggttgccgatagaacatctatcgttgcaccagacatcaagaatgttgactaccactacagaggtgataaattgggaagattagtcgttatggtgtacactcccttgcgagccacatcaggcgactttgaaatcgagctaagagttctcactacccctttaccagactttgctttcaccatgttagttccccccgct

SEQ ID NO: 76 - DNA, 750 bp, WUHARV Calicivirus 3 contig00246
ttaggcctgagaaaagtggactataaggatgcccctcacccgaccaggttttacactcccttccagcagtggaatgatggctattatgttatggacaacccaaaggggggctggactgcacaacttctacacattgcactagaaatagttaagggtgttgactggtcatcactagtgtcaaacttctccccccttaatacatggcacaattggtgcaccatggagacaactgttacgggtgtcatagcattcatagcccgcatgtgtgaattgtggaaaataccatacaccaagttgacatgtttccttagtgagacgcttttcccacaggctccattttccccacggtatataatctccgtggttttgggagccctgggtttttgtgcgtcgatattgtttaaaggaacaattaactgcctgtccaacattgttagaaggtttaacaagttctgtgagaactggaaggattttggcaacttagctagctttggaaccagtgtcctggaaacagtaatgggtgaaccacacccatgggacccacttgacaaatctgtgaatgagatactagatgaggtgggtgatggaaagattcaaactggagaccaagtttcatctaggctgggttgcgttgaggagtctataagaaagatggagctattgtctcttgaccctgctgctcccccccaattaaaggaatccatcaagagagctaaagggttgaagcaagcgctcaatgacatgaggagc

SEQ ID NO: 77 - DNA, 462 bp, WUHARV Papillomavirus 1 GZXIHWF02H3IYD
cagggaccacaatagtagttgttggggtatacacaggatatgaaacaaaaaggtgctttgcataatcagtctacaaatatttttaaacctaaaccagggggcaaagtaggtactgtatatactgaaccacgtctcccactactactaagcaccaagtgagacgagctaaagtcttctattaaggggtctaatagttcttcctcagtgtatgtaacatctgcgtttgcaattccatcaataaaagtctctcagctatgggattaagtataacgctatcacctgaatgttgtcctaaaggacctagctctattgcatctattgtatctgaagatatagtgctaagatcataataaaagtgaacattctggcctatttgagtcccactgcgagtaaatattgtaccacgtctgcctagtctactaacacgaacgcgaccggagtcggtctctgaatacctatgcc

SEQ ID NO: 78 - DNA, 174 bp, WUHARV Bocavirus 1 GZXIHWF02HMA4O
catgacagacgaggggagttacacgcacaatctattgatccgttgcgtttctttgcaaactaccttcttccaaagaacaaaaatatttcatcctacacaacacctgagatttgcacacctactgacaattgggttattttagtggaaaaaacatacgcgcacactcttatcccc

SEQ ID NO: 79 - DNA, 4287 bp, WUHARV Dependovirus 1 contig00007
ccggccccaccgagcgagcgagcgcgcatagagggagtgggcaactccatcactaggggtaaccgcgaagcgcccccaagcagttaatgtgtaagctgtaaccatggtaaccgataagataagaaggacacggagaccaaagttcaactgaaacgaattaaccggtttattgattaaccaggcagttacaagtgattagtcaaataacgagagccaataacccgcggctctgtatacttcccattactatcaggagcccacaacatagaagattgatttccatagtttgaggtaaactgcacttcgggattccagcgtttggaacgttccttttcgatttcccattcaatctgaacagcgacctggccggtgctgtattgtgtgataaaagagtccactctggctgcagtgaaagttgtcgcaggattggcaggtacgggggtattcttgatgaaaatctggggaggcgggtgtttcagtccaaacccaccaatcagaggcgaaggatgaaagtgtccatccgcgtgtgggatcttggcccagatgggtccctggtagtaaatgtctctgttttgccagaccataccaggcagtacgcccatagccgtaacattgccggttatgggagcagttgtggcattttgattattgtcagcaatttgaccaaacatgtcagtgtctttcgggttggtagcagcgatttcttcttctgatgtaaacagcaagttatcggctgtatttgtggtggttccagtgatagaaggtccagggaaaatgagctgtgcgttgctaaagttcccatctgaagatccggctgtggccataggaggtccaggtgcaatgttgctccatcggttgtttaaggtatagtgggtatcatatcttaacaaagagtcctgtccacttgaaggaatcctgtagttttcactggcagtctttgagaacatctgctgcttaacacaaggcccaggcagccagttctttctgtaaaaggcaaaattcgcgcttctgatctttccaaatgtggttgctgcattgccttgattcagagcctgtccagaggtggtcgactgcaagtgccacaggtactggtccaggagaggattcatcagtctgtccaagctctggctgtgagcatacatggagtggaacggcaccttctcaaatttgtaagccatttcaaagttgttgccagttctcagcatttgtgaaggaaagtactccaggcagtagaaggcatttctgtccgtttggttttgactttcaccagttacgatgccacagtagccatattgaggcaccataaagacgtcattggggaacgggggcaagctcccttcttgtccagcgtccatcacgtacgggagctcatacgacgagtccgcaaatatctgaaccgtgctggtaaggttattagcgaccgtagtctcgccgttcgacgttgtgacctccttaacttggatgttgaagattttgacccgcatggctttgggtcgcagtccccagttgttgttgatgagtcgctgccagtcacgtggtgagaagtggcagtggaatctgttgaagtcaaagtatccccagggggtggagaatccgttgtatgagttgctgttgaacgtggttccgagccgcatgtaccggtggttgttgtaggtgggcaagacccaggttctggttgaggtggttgtgactttgccctcagaccaggtggaatcgcaatgccaatcacccgaggcattacccactccatcggaaccttgtcccgcatcgacagaatttccgcccggttctgcacgcatttcaatgtctgaagacatggcgctggtatcagatccttcagggggtccgtctccggctccagtgtcctcctcaaagttaagtctttttttggctggttgattgccctttttaccgattcccgtggaggagtcgggctgctgtggtgactctagtggtctcttttttccaggagccgtcttagcgccttcctcaaccaggcccagaggttcgagtaccctctttttggcctgaaagactgctcgtccgaggttgcccccaaaagacgtatcttcttgcagacgctcctgaaactcggcgtcggcgtgattataccgcaggtacggattgtcacccgctttgagctgctggtcgtaggccttgtcgtgctcgagggccgctgcgtccgccgcgttaacgggctcccccttgtcgagtccgttgaagggtccgaggtacttgtagccaggaagcaccagaccccggccgtggtcctgcttttgctggttagccttgggtttcggggctccaggtttcaggtcccaccactcgcgaattccctcagagaggttgtcctcgagccaatctggaagataaccatcggcagccatacctggtttaagtcatttattgctcagaaacacagtcgtccaggtccacgttgaccaggtcgcaggccgagcaagcaatctcgggtgcccgccccagcagatgatgaatcgcacagagtttccgatacgtcttttttctgacgaccggttgagattctgacacgccggggaaacattctgaacagtctctggtcccgtgcgtgaagcaaatgttgaaattttgattcattctctcgcatgttttgcagggaaacagcatctgaagcatgcccgcgtgacgagaacatttgttttggtacctgtcggcaaagtccaccggagctgcttccgcgtctgacgtcgatggatccgcgactgaggggcaggcccgcttgggctcgcttttatccgcgtcatcgggggcgggtctcttgttggctccaccctttctgacgtagaactcatgcgccacctctgtcacgtgatcctgcgcccagcggaagaactctttgacttcctgctttgtcaccttgccaaagtcatgctccagacggcgggtgagttcaaatttgaacatccggtcttccaacggctgctggtgctcgaaggtggtgctgttcccgtcaatcacggcgcacatgttggtgttggaggtgacgatcacgggggtggggtcgatctgggcggacgacttgcacttttggtccacgcgcactttgctgccgccgagaatggccttggcggactccacgaccttggccgtcatcttgccctcctcccaccagatcaccatcttgtcgacgcaatcgttgaagggaaagttctcattggtccagttgacgcagccgtagaagggcacggcgtgggcgatggcttccgcgatgttggtcttgcccgtggttgccggcccaaacagccagatggtgttgcgcttcccaaaccttttctgggcccagccgagaaagacggagccggcgtaggcagggtcgtagccgttcagctccaggatgcggtagatgcggttggttttaatgtccgcgggcagagcggggcctaccaggtagtcgggcgcggatttggtcagcgccatgatcttgccggcattgtccagcgcggccttgatctgggaccgcgagttggaggcggcgttgaaggagatgtacgaggcctggtcctcctggatccactgcttctcggaggtgatgccccggtccaccagccacccgaccagctccatgtagcgcgcggaggtttttgaccggatgacaggcgcgtcagaattggggttcagattctccttgttctgctcctgggtctggctgacgtgggtcaggtgctgcgccacgagccgtttgcgctcggccaggttcaaacacgcgcttatatactcctccatgttagtccacgcccactgcagctcgggctgagttttgggaaggaggtagttggggatgtagcactcgtccaccaccttgttccccccgccggcgccattacgcgtcttggtcaccgcgaaccagttgggcagggtcggctcgatcccgcggtagatggtctgcaccagcttgtcccgaatctgactcaggaagcggcccagcaccatggatttgacccccgtggtctccaccagaatgtgcaggtggaagtaggactcgcccttctcgaactgaacaaagaagagggcctccggggccttactcacgcggcgccattggaccaggaagtcgcgctgcagcttctcggccacggtcaggggtgcctgctcaatcagattccgatccatgtcagaatccgggggcagctcccattccttctcggccacccagttcacaaacgagtcagaaatgcccggcaggtgctcgtccaggtcgctcggcaccttgatcacaatctcgtagaagcccggcatggctgctgctcg

SEQ ID NO: 80 - DNA, 4206 bp, WUHARV Dependovirus 2 contig00017
gcacgcatagagggagtggccaactccatcactaggggtaacccgatgacgtaagtctcttatcgcgaagcgcaaccaagcagttaatatgtaaccagttgctgtggtaaccagataatataagaaggacaggagaccaaagttcaactgaaacgaatcaaccggtttattgattaacaggcaattacagattacgggtgaggtaacgagtgccaatggggcgaggctcagaataagtaccctcagtattgacagcaaagtccacatttgtagatttgtagtagttggaggtgtactgaatttctgggttccagcgcttgctgttctccttctgtagctcccactcgatctccacgctgacctggccggtgctgtactgcgtgatgaacgacgccagcttggcctgattgaaggtggtcggaggatccgcgggaacaggtgtgtttttaatcaggatctgaggaggcggatgtttcagtccaaagcctcccatcagcggcgagggatgaaagttgccgtccgtatgaggaatcttggcccagattggaccctgcaggtacacgtcccggttctgccataccatgccaggtaaggctccttgactgttgacggcccctacaataggagcggcgttttgctgttgcaggttatcggccaccacgccgtactgttctgtggctacagggttggtggtcttaatttcttcctcactggttagcattacgctgctatagtccacgttgtcttttccagctccctgtttcccaaacatcaagactccgctggatggaaaaaatcgctcctcgtcgtccttgtgggtagccatggcaacgccaggatttaccagagagtctctgccattcagatgatacttggtggcacccgtccaggcaaagttgctgttgttattctggttggttgttgtggagacgcgttgctgccggtagcagggcccgggtagccagtttttggcctgagccgacatgttattaggcccggcctgagaaaatagcaactgctgagttcctgtggtacctcccgtggactgagtccgagacagatagtacaggtactggtcgatgagagggttcatcagccggtccaggctttggctgtgcgcgtagctgctgtgaaaaggcacgtcctcaaactggtagctgaactcaaagttgttgcccgttctcagcatttgagaaggaaagtactccaggcagtagaaggaggaacggcccacggcctgactgccattgttcagagtcaggtacccgtactggggaatcatgaagacgtccgccgggaacggaggcaggcagccctggtgcgcagagccgaggacgtacgggagctggtattccgagtccgtaaagacctgaatcgtgctggtaaggttattggcgatggtcttggtgccttcattctgcgtgacctccttgacctggatgttgaagagcttgaagttgagtctcttgggccggaatccccagttgttgttgatgagtcgctgccagtcacgtggtgagaagtggcagtggaatctgttaaagtcaaaatacccccagggggtgctgtagccgaagtaggtgttgtcgttggtgcttcctcccgatgtcccgttggagatttgcttgtagaggtggttgttgtaggtggggagggcccaggttcgggtgctggtggtgatgactctgtcgcccagccatgtggaatcgcaatgccaatttcctgaggaactacccactccgtcggcgccttcgttattgtctgccattggagcgccaccgcctgcagccattgtaccagatcccagaccagaggggcctgctggtggttctccgattggttgagggtcgggcactgactctgagtcgccagtctgcccaaaattgagtctctttttcgcgggctgctggcctttcttgccgatgcccgtggaggagtcgggagaacgctgcggtgagggctctaccggtctcttctttccaggtgccgttttaaccggcgattcaaccaggcccagaggttcgagaacccgctttttggcctgaaagactgcgcgcccgaggttgcccccaaaagacgtatcttcttgcagacgctcctgaaactcggcgtcggcgtggttataccgcaggtacggattgtcacccgctttgagctgctggtcgtaggccttgtcgtgctcgagggccgcggcgtctgcctcgttgacgggctcccccttgtcgagtccgttgaagggtccgaggtacttgtagccaggaagcaccaaaccccggccgtggtcctgtttttgctggttagccttgggtttcggggctccaggtttcaggttccaccactcgcgaatgccctcagagaggttgtcctcgagccaatctggaagataaccgtcagcagccatacctggtttaagtcatttattgctcagaaacacagtcatccaagtccacgttgacgagatcgcaggccgaacaagcaatctcgggtgcccgccccagcagatgatgaatcgcgcacagtttctgatacgtcttttttctgacgatcggttgagattctgacgctccggggaaacattctgaacagtctctggccccgtgagtgaagcagatattgcaattctgattcattctgtcgcatgttttgcagggaaagagcatctgaagcatacccgcgtgacgagaacatttgttttggtacctgtccgcgtagtccaccggagctgcttccgcgtctgacgtcgatggctgcgcaactgacaggtgcggcctcttgggctcgcttatatctgcgtcactgggggcgggtctcttcttggctcctccctttctgacgtggaattcatgggccacttcagtcacgtgatcctgggcccagcggaagaactctttgacttcctgttttgtcaccttgccaaagtcatgatccaggcggcgggtaagttcaaacttgaacatccggtcttccaacggctgctggtgctcgaaggtggtgctgttcccgtcaatcacggcgcacatgttggtgttggaggtgacgatgacgggcgtggggtcgatctgggctgaggacttgcatttctggtccacacgcaccttgcttccgccgagaatggccttggcggactccacgaccttggcagtcatcttgccctcctcccaccagatcaccatcttgtcgacgcaatcgttgaaaggaaagttctcattggtccagttcacgcagccgtagaagggcacggcgtgggcgatggcttccgcaatgttggtcttgcccgtggtagcaggcccaaacagccagatggtgttgcgtttcccaaactttttctgcgcccagcccaggaagacggagccggcgtaggcagggtcgtacccgttcagttccaggatgcggtagatgcggttgtcccgaatgtccaggggcaggttggggcctaccaggtagtcgggcgcggatttggtgagcgccattatctttccggcattgtccagagcggccttaatctgagaccgcgagttggaggcggcgttgaaggagatgtacgaggcctggtcctcctggatccactgtttctcggaggtaatgccccggtccaccagccacccgaccagctccatgtacctggcggaggttttcgagcggatgacgggcgcgtcagaattgggattctgattctccttgttgtgctcctgcgtctggctgacgtgcgtgaggtgctgcgccacgagccgtttacgctccgcgaggttcaaacaggcgcttaaatactcctccatgttagtccacgcccactggagctcaggctgggtcttgggcagcaggtagttggggatgtagcactcgtccaccaccttgttccccctccggcgccattacgcgtcttggtcaccgcgaaccagttgggcagggtcggctcgatcccgcggtaaatgcgttgaaccagcttgtcgcgaatctggctcagaaagcggcccaggaccatggacttgacccccgtggtctcaatcagaatgtgaaggtggaagtagctctcccccttctcgaactgaacaaagaagagggcctccggggccttactcacgcggcgccattcgaccaggaagtcgcgctgcagcttctcggccacggtcaggggtgcctgctcaatcagattcagatccatgtcagaatccgggggcagctcccattccttctcggccacccgtt

SEQ ID NO: 81 - DNA, 1807 bp, WUHARV Dependovirus 3 contig00030
gggtgccaatggggcgaggctctgaataaacaccctggctgtcaacggcaaagtccactccagtttgtttgtcaaagttggaggtatactgaatctctgggttccatcgcttgctgttctctttctgcagctcccactcgatttccacgctgacttgtccggtgctgtactgcgtgatgaaggaggcaaacttggcaggagtaaacacttctggagggttagcaggtaccggtgtgtttttgatcaggatctgaggaggcgggtgtttcagtccaaagccacccatcagaggagacgggtgaaagttgccgtccgtgtgaggaattttggcccagatgggaccctgcaggtacacgtcccggttctgccagaccatgccgggcagagccccctggctgttgacaacttgagtctgggctgcagtgctagacgattgcaggttgctggagaccacaccgtattcttctgtagccacgggattggtaggacgaatttcttcttcatttgtcatgagcacgttttccaatgtagttttattagttgctccagttttgccaaaaattaaaactccgctcgaagggaagaagcgttcctcgtcgtctttatgggttgccatggcaataccaggattaaccaatgaatttcttccatttaaatggtatttggtggcaccagtccaggcaaagttgctgttgttgttttgatccagcgttttggatactctctgttgccggaagcaaggtccaggcagccagttctttgcttgttcggccatggtggtaggtccgccctgataaaactgcagttcccgattgccggcggtacctcctgcgttgctctgtgttctggccaggtagtacaagtactggtcgattaagggattcatcagccgatccaggctctggctgtgcgcgtagctgctgtggaaaggcacatcctcgaaggtgtagctgaaggtgaagttgttgcccgttctcagcatttgagaaggaaagtactccaagcagtagaaggaggagcggcctaccgattggctgccattgttcagagtcaggtagccgtactgcggaatcatgaacacgtccgccgggaacggaggcaggcagccctggtgcgcagagccgaggacgtacggcagctggtattccgagtccgagaagacctgaaccgtgctggtaaggttattagcgatggtcgtaacgccgtcattcgttgtgacctccttgacttggatgttgaagagcttgaagttgagcttcttgggccggaatccccagttgttgttgatgagtcgctgccagtcacgtggtgagaagtggcagtggaatctgttgaagtcaaaatacccccagggggtgctgtagccgaaatagacgttatcgttggtgctccctgctgactggctggatatttgcttgtagaggtggttgttgtaggtgggcagggcccaggtgcgggtgctggtggtgatgactctgtcgcccagccatgtggaatcgcaatgccaatttccggaggcattacccactccgtcggcgccttcgttattgtctgccattggtgcgccaccgcctgcagccattgtaccagatcccagacctgagggcgcggcgggaggttctccgagaggttgtgggtcgggcactgactctgagtcgccagtctgcccaaagttgagcttctttttagcgggctgctggcctttcttgccgatgcccgtggaggagtcgggggattctatgggtctcttctttccaggagccgtcttagcgccttcctcaaccagaccgagaggttcgagaacccg

SEQ ID NO: 82 - DNA, 1146 bp, WUHARV Dependovirus 4 contig00061
tcggagtatcagctaccgtacgtgctaggctctgcacaccagggatgcttgcctcgttcccggcggatgtcttcatgattccccagtacggttacctgacgctaaacaatggaagtcaggcgctggggcgatcctccttctactgcctggaatactttccatctcagatgctcaggactggcaacaactttcagtttagctacacatttgaagacgtgcctttccacagcagctacgcgcacagccagagcttggaccggctgatgaaccctctgattgaccagtatctgtactacctggtcagaactcagaccactggcacgggtggaactcagactctggcattcagccaaggagggcccagcactatggccaatcaggctagaaactgggtacccgggccctgctatcggcagcagcgcgtttctacaactaccaatcaaaacaacaacagcaactttgcttggaccggagcagccaaattcaagctgaatggccgggactctctgatgaatcctggtgtggccatggcttcccacaaagacgacgaggaccgcttcttcccatccagcggagtgctgattttcgggaagcagggagccaacaaagacggagcagactccagccaggtgctgattacagatgaagaagagattaaagctacaaaccccgtggctacagaggaatatggatcagtggccatcaacaaccagaatgcaagtacgcaggcgcagactggacttgttcacaaccagggagtcattcccggtatggtctggcaaaacagagacgtgtacctgcagggtccaatctgggccaagattccacatacagacggcaattttcacccgtctcctctgatgggcggctttggacttaagcacccgcctccacagatcctgatcaaaaacactccggttcctgccgaccccccgcttacctttaatgaagccaagctgaactctttcatcacccagtacagcaccggccaggtcagcgtggagattgagtgggagctgcagaaggagaacagcaagaggtggaatccagagattcagtacacttccaactactacaaatctacaaatgtggactttgctgtcaatacagacggtgtatatagcgaaccccgccccattggcactc

SEQ ID NO: 83 - DNA, 160 bp, WUHARV Dependovirus 5 GZXIHWF02F90YN
ttcaagaaggtgatgacccggtactacgagccacccgaccagactccatgttagcgcgcagatgtttttgatctgatgacgggcgcgtctgaatttggtatcagattctctttgttctcgtcccgagtttgactgacgtgcgtcaggttagctagggacc

SEQ ID NO: 84 - DNA, 337 bp, WUHARV Dependovirus 5 GZXIHWF01CFM8N
cacgctgtcaaaaaactgcgcggaatgttttccgtcagaagctcctcaggttgtcaaaaagacttataagaaactgtgtgctgttcatcacatcatggggcgggctccggagattgcctgctcggcctgcgacctggtgaacgtggacttggatgattgcatttctgagcaataaatgacttaaaccaggtatggctgctgatggtatcttccagattggctcgaggacaacctctctgagggcattcgcgagtggctgaacctcaaacctggagcgcctcagcccaaggccaaccaacaaaaacaggacaacgctcggggtcttgtgcttcctgga

SEQ ID NO: 85 - DNA, 450 bp, WUHARV Dependovirus 5 GZXIHWF01BRKBZ
caatcgctgggaacctttaccacgatctggacgaacatctgcccggagcttctgacagtttttgtcaactgggtggccgacaaggaatgggaactgccttcggattctgacatggacatttcgctcattgaacaggcacctctaactgtggcagaaaagatccagcgcgacttttacgtcgagtggaaacgggtgagcaaggcctcggagccactgttttttcaatcaatttgagaagggggactcgtatttccacattcacatgctgattgagaccactggagtcaaatccatggtcctcggtcgatatctgacacaagtcaaggacaggcttgtagcccgcattttccggaatgtggagccgactatgccaaattggttcgcagtaccaagacgcgtaatggcgccggaggggggaacaaggtggtggacgagtgctacattcccaat

SEQ ID NO: 86 - DNA, 497 bp, WUHARV Dependovirus 5 GZXIHWF01BTC0A
  misc_feature (497)..(497): n is a, c, g, or t
ggggggggggcgtttgttggctccgccctttctgacgtaaaactcatgagtcacgggcacgtcattgtcttgcgcccatcgaaaaaagtcacggacttcctgcttggtgaccttgccgaaggtgtgctctagacgatgagtcagctcgaacttgaacatccggtcctgcagcggctgctggtgctcgaaagtggtgctgttcccgtcaatcacggcgcacatgttggtgttggaggtcacgatgacgggcgtggggtcgatctgggccgaggccttgcacttttggtccacgcgtaccttgctgccgccgagaatggccttggcggactccacgaccttggcggtcatcttgccctcctcccaccagattaccatcttgtcgacgcaatcgttgaagggaaagttctcattggtccagttgacgcagccgtaaaagggcaccgcgtgggcaatggcttccgcgatgttagtcttgccggtggtggcgggcccaaacn

SEQ ID NO: 87 - DNA, 575 bp, WUHARV Dependovirus 5 contig00278
agaccagtcacgggggaggtggacagccagggggtgcttccgggcatggtgtggcaggaccgggacgtgtaccttcagggtcccatctgggccaaaattccccacacggacgggcactttcacccgtctcccctaatgggtgggtttgggctaaaacatccccctcctcagattctgattaaaaatacgcctgttcctgccaacccagccacgacttttactccgggaaagtttgcctcttttatcacccaatattccaccggtcaggttagcgtagagatagaatgggaacttcaaaaggaaaatagcaaacggtggaatcccgagatacaatacacctcaaactataacaaatctgttaatgttgatttcactgtggataccaatggtgtgtattctgaacctcgccctattggaactcgttatctaacgagaaacctgtaatgtggttaatcaataaaccggttgattcgtatcagttgacctttggctcacgtgtggttaatatttaaatctccataacaacggcctgcggcgccttcttgtttataaacattggtgacgtgtttccgctt

SEQ ID NO: 88 - DNA, 839 bp, WUHARV Dependovirus 5 contig00538
ctcccctggagcgcctcagcccaaggccaaccaacaaaaacaggacaacgctcggggtctttgtgcttcctggatacaagtacctcggacccttcaacggactcgacaagggggatcccgtcaacgaggctgacgccgcggccctcgagcacgacaaagcctacgacaaacagcttgcggacggagacaacccgtacctcaagtacaaccacgcggacgccgaattccaagagcgtcttcaaaaagatacgtcttttgggggcaacctcggaaaggccgtctttcaggcaaagaaacggattctcgagcctttgggcttggttgagacgccagctaagacggctcctggaaagaaaagaccggtagagccatctcctcagcgttctccagattcttcatcgggaataggcaaaaagagcccgcatcccgccagaaaaagactcaatttcgggcagactggagaagcagagtcagtgcccgaccctcaacctctcggagaacctccctcagacccctctagtgtgggatctggtacaatggctgcaggtggtggcgcaccaatggcagacaataacgagggtgccgacggagtgggtaattcctcgggaaattggcattgcgattccacatggatgggcgaccgagttattaccaccagcacccgaacctgggccctgcccacctacaacaaccacctctacaagcaaatctccagccaatcgggtgccagcaacgacaaccactacttcggctacagcaccccttgggggtattttgatttcaacagattccactgccacttctcaccacgtgactggcagcgactcatcaacaacatc

SEQ ID NO: 89 - DNA, 4908 bp, WUHARV Parvovirus 1 contig00013
gcatagaatggatcaaaaaaactacatagagagctgtggactaagtttttgtattcaaaatacatgactgcatctacaaaccaactaaagatggacaaggaccaaaaatcacatggagagactacagaaaaccaagcaaacatcctgacatacaagaagtctacaaactagatcaacaaactgtaagtaccagagatccagaaccggactctgaaattaacatagatggaacaccattcaaacaaggaataatattaacaagtttagttaaaaaaatactatttgactacttcaaaaccaaaaatataataccagaagaaattgactggttcatgcaaactgaatacagtgaaaatactgaactacacatccatgtaatcctacatagtgataaaatagactctaaatcaggcaaatggatgtgcaaatactttggagaaaaatggggcctaatgctttgcactgtactaaacatgccaaaagaaaacttatcagactttttcaaccaaactaaattcagacaaacagtagaaaatgatgaatgggtacaagtccttcaatatactcatccacaaactaaaaaaaaatattgcaaaccagttaactttggagaaataatccatacttatttcctcagcaaaaaacctattttacaaaaagcaaatggtgaatgtggttacatctacagctcagacagtggtttccggatgaactctctatgctttaatgacagatggttaattcaccaacacttacgtgagctatctatgagaaaggaaaccacacaaatacaaaccatatcacctcaagacaagaaaaaaaaaagattagaaactgcaaaagaacaatcaattaaagaaacaatctatacattaacaaaaaacaaactacatacagcagaaaaatggatgcttggtgatccagacagctacatccaacacatagcaaatccaggtggagaaacagtaataaaagcaacattagacatagtcactctaaaaatgagtgtagaaaaaacagcataccaactaattatagaaagcaaacatgaaaaaatcaaacatatcaaaaaatgcaaagcatggaaactaatgaaagacaacaacttcaatccaaaaaaaatatggcactgtatatcatgtgcacttaacaaacaaatgggaaaaagaaataccatcttactatgtggacctgctagcacaggaaaaagtctattagcacaaaaaatagcacaactagttggtaatgttggatgttacaatccaagcaatgtaaactttccattcaatgactgtagcaacagaaatctaatatgggttgaagaagctggtaactttggtggacaagtaaaccaatttaaagcaataatgagtggacaaagcattagactagaccaaaaaggaaaaggaagcaaagcaatagaaccaactccagtaataatgacaacaaatgaagacattacaaaagtaataattggttctgaaaccaaaccagaacacaaacaaccaattatggacagatgttgcagaatagaaatgaaaaaaagattagaaggtgactttggtttactagaagatggtgaaattccaagcatcttcaaatggttagaaagtaaagcattcctaccaacaatggcaaactactgcgccagatggggagctcctcctacatggggagaaaactggaatactaaacctaaagaacttggaacagaactcatttcagatgaagaaactgaaccagaaacatctaaacctaacctctatcaatcccttgatccaactggactaaacgcagatttccaacttcttctacaagacatagaagaaactgaaaaacaataccaacaatatatggaaccaacagatgaagaaattgcagaacttgcagaaaccggctatggtcaagcactaattgatggcactgcaattcaaagttcaaccagcagagggccattgaatgcctccaacaaaaagggaattagaggtaagtcactatcactttaacaatggataacctactaagagcactgcctgtgctcttaggctttctattaatgctactaattttcttgctattttgctacatctgctgcaatggaatatacaactttcacaaaccaactaacattcttggagctaatcacagaagaaccaacctaaccatcataatgagcttcatgcctgccttactaagcttctctgtaactatgcttatatgggccttattcatatggctattttattttcatgaaggaacaatagaacaactaaacatataccataatggaactcactacaacttctccatcactcatcttcattaacaggttgggttcctcctggctacaactaccttggacctaaaaattcaaacttcaaaaaaaaccaactaacccttcagacgctgcagcaagaaaacacgatttggaatacaacaaactaattcaacaaggacacaatccatacttctactacaaccacgcagacgaagacttcatcaaagaaaccaaccaagcaaaagactggggcggcaaatttggaaactacatcttcagagcaaaacgcgctctagcaccagaactggcaccacctaaaaaaaaatccaaaactgaaaaaggagaaccatcctacagctacaaaaacatcaaaccaggcaccaaaagaggtaagcctttctacttatttgttaaccttgcaaaaaaaaaacgaatgtctgctcccgctgcagaaaacaatgaccaacaaccagacgcagcagagccttcagtggctggagcaaaagctacaggaggtggcggtggaggtggatcaggtgtggggcacagcactgggagctttaataacaggactgagtttatttatcatggcagtgaagttactattatatgtcatgcaactagacatatccaccttaatatgcccgactcagaagaatacaaaatctatgaaacaaacagagggcctagattcccaaccgaccaaactctgcaaggtagagacactataaatgactcttaccatgcaaaagtacaaactccatggcaactactccatgcaaactgctggggctgttggttcagtccagcagactggcaacaaatgatcacaacttgcagagaatttaaagtagaacacctagaacaagcaattgacaacattgtcataaaaacagtaaccaaacaaggaacaggcgctgaagagatcactcaatacaacaatgatctcacagcacttctgcaagtagcagaagacaaaagcaacctaatgccatgggctgcagataacatgtacattgattcaattggttatgtcccatggagacccagcaaactaccaacatactgttaccatgtcaacttctggaacacaattgacataaatgctggtgctcaacaaaaccaatgggcagaagtcaaaaaaggcatacaatgggacaacatccaattcacaccaattgaaaacatggttgacattgaactcctaagaacaggagacagatgggactcaggaccatacacattctactgcaaaccaagcagcctagaatatcactggcaaagcactagacacaccggcagctgtcacccatcaaccacaccacaagccatcggcagtgtcggaaacaaccttgaaacattaaatgcatggcaatggggtgacagaaacaatccaagcagtgcttccaccagagtatccaacttccacataggatactcctggccagaatggcaatttcactactcaacaggaggtcctgtagtcaatccaggtcaaccattctcacaagctccatggggctcagaggttgcaggaaccagactaactcaaggcgcctctgaaaaagccatatatgactggaaccatggagatgaagaacaccaattcagagaaacttggtggcaaaacaatgaaaacatgactggacaaactaactgggcaccaaaaaacatacaccaaaaagaactaacaaacaatgttgctgcacaaacagccttctgggcacaaggctaccacaacacattcggacctttcactgcatttgatgatcacggagcacaatatccatggggagccatctggggcaaagaaccaaacacaactcacaaaccacttgcatcatctcacgcacctttcatgacagcaaatccaccaggacaaatattcgtcaaacttgctccaaactacacagacacagtagacaacaacggaaactcatcaagaatagttacttttggaacattttggtggacaggaaaactggtgatcaaagcaaaactcagaactccaagacaatggaacacgtaccaactaccatcacttgctgcaagagaaaccatgaaagaaactgtaccaaatgaaattggcaactttgaaataccatacatgccaggaagagccatgcctaactacaccctttaaccttctaatctactaaccaacaataaagtaagttactaacatactaatactactaattaataaatttagtttaataagtttagtttaataagtttaatttaataagtttagtttaataagtttagtttaataagtttagtttaataagtttagtttaataatataaatttagtttaataatttagtttaataagccaatatactgataccatggtgctgctatttctccaacataccctttccttactaaccatacttagtttaataggtttaattttactatgttatgaagaaatcatagttagtttactcctattacaatgcttgcaattagcccagctcttgcatagacttcactgacaccttttgtcaccaaaaaaatcaataaaaccaaccatttaaaatcactcaagactactgtcattattggaacaccaaccaaacagatataactgtataccaaactgtataaaagggtgggcgggtg

SEQ ID NO: 90 - DNA, 470 bp, WUHARV Parvovirus 2 GZXIHWF02H245M
gttggtgtagatgtatggattgtgtccttcgttgattagtttgttgtattccaaatcgtgtttttttgctgctgcatctgatgggttagttggtttttttgaagtttgtagtttttaggttccaaggtagttgtagccaggaggaacccaacctgttaagagagtttagtaattgtaaagttgtaatgtgatccattgtggtagatgtttagttgttctatagctccttcatggaagtaaaatagccatatgaataaagcccatataagcatagttattgagaagcttagtagtgcaggtaagaagctcatgatgatggttagttgagtatttttgtttttgatcctagtaggttagttggtctgtggaagttgtataatccattgcagcatatgtagcagaatagtaggaaaattagaagcattaagataaagcctaagagtacaggtagtgctcttagtagtgcatcc

SEQ ID NO: 91 - DNA, 478 bp, WUHARV Parvovirus 2 GZXIHWF01BFLV1
ttggtttgtgagttgtatttggttcttttccccagatggctccccatggatattgaggtccatggtcgtctactgcagtgaatggtccgaatgtgttgtgataaccttctgtccagaaggcatcagctcttgctacattgttattgagttctttttggtgtatgtttcttggagcccagttggtttgtcctgtcatgtgttcattgttttgccaccaagtttctctagctcctgtggtgtcatctccgtggttccagtcaaatatggctttttctgaagcgccttgtgttagtctggtttggcctacttctgagccccagggtgcttggctgaatgcagagcctgggttgactacaggtcctcctgtggagtagtgaaactgccattctggccatgagtaaccaatgtggaagtttggatactctggtagaggcgctgcttggattgtttctgtctccccattgccaggagttgattg

SEQ ID NO: 92 - DNA, 690 bp, WUHARV Parvovirus 2 contig00138
acaaactactgctaccatgtagacttctggaacacaatcacaatcaatgcaaatccagcaacctggactcaaacaaaaacaggcattcaatgggacaacatacaattcactcccattgaaaacatggttgcaatagacctactcagaacaggagacagctggcactcaggcccatacacattcaaaacaaaaccaaccagcctagaattccactggcaaagcaccagacacacaggaagctgccatccatctactacaccatccacaatcggaggcataggaaacaacaataactcaatcaactcctggcaatggggagacagaaacaatccaagcagcgcctctaccagagtatccaacttccacattggttactcatggccagaatggcagtttcactactccacaggaggacctgtagtcaacccaggctctgcattcagccaagcaccctggggctcagaagtaggccaaaccagactaacacaaggcgcttcagaaaaagccatatttgactggaaccacggagatgacaccacaggagctagagaaacttggtggcaaaacaatgaacacatgacaggacaaaccaactgggctccaagaaacatacaccaaaaagaactcaataacaatgtagcaagagctgatgccttctggacagaaggttatcacaacacattcggacca

SEQ ID NO: 93 - DNA, 2451 bp, WUHARV Picobirnavirus 1 contig00041
gccgagacgaacagacataatcttcagactgaagctactgctaatgcgacgcagcaggagcaagttcgtcataacaaacaaactgagagtgttgacttctcacagctgcaagaaaacgttagacacaacaagcaatctgaaacaactgaggcatttaaggcgcaagagtctcagagacataatcaggttagcgagtcacagacgtggacgtcgatagcggaacagcaacgtcacaatcaagctggcgaagctgagacgtcaagacataattatgcgcaagaagcagctacactgtctcaaattagtgagagtatcaggcacaatcatgcatcggaggctcagcaattagcagagctgagcgaaacaatcagggctaataagcaacgtgaagcgaataccgttgcatccattcaagccacatatgcgcagcttgaagaacagattcgctcgaataaagcgtcagaagcaatccgtcaaacggcgaatctactaactaatcaggccaatgcgattcgaagcgatgcaaacagaattcaggaaaactataatgatgccactgctaaattaggaatgctaaattacgcagcatcttctaatgcaagttcatctcagaacgctctaaataaagcgttaacttctcaggcttattcaaattcgcaacaggcgcaagccaaagccaatgagatcaactctaaattaagcgcggagttggagaaactgaacaaagggttgcgagatcaggattactcttttgttaaatccgtagttaaagacatcattacattgggtggatcactgtccaccatgctatatgaataggaggtatagtaatatggcaacacgtaaaccgaaaaagactcgtcagccaaactggcgagcaagagctccgaaaaattcaggggataaggcagctctcgattcagacgctagatttatggagcaagcgtcagagcgaaagaaaggaaatgatattagttattacaatcattctcctgagatgctgcagatggcgggaaaattttcttttgctaatgcattaggtggattccttcccgacaaatcactcactaaggaaccaatcgatgacaaatttgcaatttatcgaagcgttgaagacagttcaaaatttataaaccaggcaattggtacggtaactgttccaggtattatgacttttgaaacagcattggttcctggcttttctacaaacaatgaaagcgttgtgaacattgcagcacggcaattatatacagcagttcgggcacaacagacaactaagttcgacttcgacgtaccagacttaatgatgtactgtttaaccatggataacgtgtattcatactatgtgtggatgcagcggttatatggaatcatgaataactatcaagttcttaatcgatacgcacccgacgaccttattcgtgctaaccacgtagaccctgtagacttacgcaaacatatggcggacttactattttatttagagcagttcgtcgtgtatgctaagccgtactctattccaagcgatatcatgtatttccggagacatggcgaaatgttcgccaatgtgtacaaagatgggatgggtgataaggctcagttatatatgtttgtaccgtacggtttctttaagtttaacgaaaccagttcagaagcaccaataggtgcactgtcgttgcagccgattggactcacgacaaataatagctttaaattgatgacattcgacgatatcgttacttatggtaacgcgcttctagacggaataagatattcagaagatgcagcgaatatatctgctgcgctaattaaagcgtttagctacgagacgtatgcattctcgcagaccgaccgttcttatcttgtgcagccagtgtataatgaagagatccttttgcaaatccataactgtcgatcggtaggaccactttcaactggcgcagatatcacacaagataaaactacaaatgcaattctgtttacaccagcaatatctgcttcaattcagcaggagcagttaattgattcatggtattccgatccaactcctgagcaggtaatgacgatgacgcgcttttctggcgtaattcagtcgggaggagatcagtcatccggcatgttcggtgccgaattaatatgcaatatggtcgtttacaagcgtttctttgagagacgaacagctaccgatacggtagtcaagctcggattttatagattccaatccgaatatcagcttactaatacagcaaacgatcatgttcccgctatcatgaacatgatttctgcgcttaccgatatttcccgatttgactgggcaccgttaatctaccggaagattgacgactcacttggagccggtgccgcacgcgtaacggcagtcaacgaaatatttggtgacttagagaactacacaactatctcagccgaagatctgagaaagttacatgaggt

SEQ ID NO: 94 - DNA, 2160 bp, WUHARV Picobirnavirus 2 contig00009
ggccacagagatacaatactttgtatctaggtgagacagagagaagtcatcgtgctacggaagatctaagatcccaggaacttactgaagtagctagatcaaacttagctcgtgaaactgagacaaatcgatctaatctggcccaagaacaggaaacctaccgttccaacaaagctagagaaagagagacgtctcgtagcaatcgcgcacaagagcgtgaattagtacgatctcaccaagtggctgaacgtgaaattgaacgttctaaccgagctagagaaattgagaacactaggtcgtcgaagttagagaagctgagagctataggtccaacatccagaatgaagacattaagcgatcagccaattacgttaatgctttacaacaggcagaaacgaaaagatcaaatatgcgtaacgaagaattacgtgattatgacttaggtattcaagctcgtaactatgccgctaggaatgcaattgagtttaggaaaactgaactcgaaaaagctaagttaaatgagacacgaagacataatactacgtccgaagtgatcgaagtaggacgaattgcgtctcaaacagcaactaatttattaagcaatgttttaggtaagaaaaggagaaaataattatgtctaaaaaccaaactgaaacaacaacaaatagtaagaatagcgataaaggtaggaataataataatcgtagaagaccaaatcctaacagaaataataataggcctaaagagaaagagaataaatcagtatttgataaagggtgtgaacgtactcagtatggcaatgacgttagctggtattcgaagaaccctgaattgatgaagtctgcttcatctcttcctttctcttatactactggacagaggttacctttcacaggaactactagtgtgcccggtatacttcgagtaacctatgtacctaacatgggatattcatatattgaaggctcaattccacacgatgcggaagcatttgctaattcagcagttaatttggcggctaaatcaatttattcttatacagtccacgccaattccagaaatcagtcgtatgatgccactgatgagatgctgattatattagctggatcacaggtattttctatgattgcccatgcaattagagcatatggagtaatgagaacgtatgctcagcagaattattatatgccacgagcattagttaaagctttgggttttgactacactgatatcgttaagaatatgtctaaaatgtggttcgacatcaatcagatgattgctcaggtatcacagatctggattcctaacactttgcccttaacaaaacgttggttctggatgaacagcaacatctttactgatgcaccagggatcaaatctcagatgtatttattcgttcctgataaattctacatttatgatgaaacttcagatcctaacggcggtaagttagttgctaataattggcgtgctgatgccaacttcacttgggaagaatatgtagatatggtaaatgtagcaattaacgcgttactaaattctcaggacagaggaattatcatgggtgatatcttaaaagcatatggcgcagacagtatctatactttaactgagattgacagcagttatacattacttccagtatatgatactgaagttttaactcagattgaaaactcaacatctatggctaatgttgcttctgagatccgtcaaagcgaagaaggatatttatatatgtatgctgcagcgagtgaaacaactcctaacaggcaaaccattccgatgtttaatagtgtattaaactatcatattgcacaggaacctacacctgatatgaatatggttgcaactcgcttgaaaaatcatggtgtatattatgtccatacccctgaaggtggtcagataacaaacgttgttgctaactctgacgcttctgaaatagtagttggttatgatatttatcaatatggggataatggtactattgaagttattccaatgcattcagtgtgggtcggcagtgatattactgctgtagttaaagggttaacagcttggtctgcctttgattgggcaccttggatttacttcattgatgatgctacatacacaaagtggataaatggacaggtacctgctccagatgttactctacgg

SEQ ID NO: 95 - DNA, 1970 bp, WUHARV Picobirnavirus 3 contig00061
atattgccacagaatacgaaacagtgcgtcataatgttaggaccgaagaacaaacagataggactatcggtgaaaacattcgacacaacaaagcaacagagactgagacacgtcgccataatctcaggactgaagatcaaaccgatttgtcacttggtgagacaatcagacataacatggcacaagagaatttgacacgtcaatcaaattccttgaaaagtagagaactcgaccttaaggaagagttaaatacgagtacaatagaccttaataaagctaattattccctagctcgcaagaagggagttgctcagactcttgaaaataaatttcttcaggagacttataataacagagtttctaccgctagagcagaaactggtcttagatgggcagaaggagcttccaaaactatcggaaacttgttctctgtatttggagcattttctaaaattaaaggttgattactcattactattattttattatttaaggagattttattatgtctaagcaaaacaaaaattataacaacaagaaacaaggaggtcgcaagactaatgaaagaggtagtagagatactagaaaagacaattgttataatcgcgatagtggcagtcgcactagtgactatagcggaaaagctaacatggataatttagctgacgctggttacggacacgaaaacgatcctgcttggtatactacaagcaagcgtttaacagatgatgttatgaaagttccttttggttacacaggttggtactaagatgagctggaatagtgacctatttaatagtgaacatgttattcctggcgttatgcagatggctatgacaacaatcccaggtatcgctagaacctcaagcgatggtgttaacttagcagcacaatccttgttcacacgcgttcgaaaagatttgagcactactgcgtcatacgcacctgctgatatagcgatgtatgttatggcgatggatggattattccagacatatgctcacatcagacgaatattcaaattattcaacttatattcatctgtcaacttatcatatccaacgactattttaagagcatgtggatttactgatgatgccattgcagaagcacgtggcaatatgaatcagttgagatcatattttaatcagttaatatataaagctgcagctctatacttgccagttggttttagtcttattgatcgtcacacatggttattctctaatgtgttcattgattcgatgaatccaaaagcacagattatcattcacgttcctaacgcttactggttgttagacgagaccgtcagtgatcaaggtacggctctccgtcctatatataccagaatcaaagatactgtcagattacctgacttattggagatgtttgaattacagatcgaagctattagaaattccgattcaatgtggaagattcaagctgatatgcgaagagcattcaacgattcaacaggtagatatgttatggctttaattgatgagaatgaactcatcgatccagtatacagtaaagaagtcctctcacagattgagaatacaacaatctgccctcatcttcctacagataagacttttattccatcttggtatattacacaaagcgtaaataagaatattttattgttcactcctaaatggaagatttcagaacaattttcatggattcagcaagatgttgataaaacatatagtgcaaatcgtattttaaatatgcactgggagaatccaaccgctgatgatatcgcagttgctacacgaaatatggattttattcgcgcaacagacgaaaatactatggaacttacatcagctggctctgatatttgtaccggatgtgtcatttataagtataatgataaaatatctgatatcagatctttcaactcttctgcaaatatgactccacaagttgttgcagattgggcagcttttgactgggcaccccca

SEQ ID NO: 96 - DNA, 1612 bp, WUHARV Picobirnavirus 4 contig00030
ttaagcgggtgtaaacaaataagtctgtgcttttgaagatgaaggatcatctgcataaatatttatcgcacagccacatatgacgacggtgatacgacatatcactgggaatacacagagctcccatctgtacggcaaatctattgatcagatacctaaaattaggaagatttgctataatgtcatcaaagtttactcccatagattcaataattgcacggggatagtatctatttgtagcagaatacaggctacaaagtccataaattctgcgcataaatgcgtggagcatatatccgctgtcaacagccaagagatacatcataagatcaggtgcatcataattggcatgtcccgaatttgcatgacgcacgaacgtatacacgttagtagcagccacattaatgggacttgttctatcccgtgatataccgatggtcggtacgaatcgtaatgccattactccaggaacactatacttaggaatggaagttgtcgaatatttagagttaagatcaatagcattacccgcaggccagccgtaggcaaagcttgcagaatcagccaaaagctgagaattacgagcataccactcaatatgatttccatacaattttgagttctgagatgctccagctttagaccctctgtagttcttacctttgccagactgtatatcctcatcgtaacctctccttttgtcaaacttctcatttgctttgttaactttgcgtgccatataagacactcctttcttattcaagtgttaataatagtttgaagagttgtaaggcggttccagacgccccacctttcgctttagagatagcttccaaccctttgatagctatattcacccaaccttgggctgtatcagcttccatcttattgagtttaccgctattcaaagcctcttcgagaagtactttcgcttgttcgatctgaattttctgatcgttgtagcgtttagttatttgatttaagtcattcttaagttgaagaccccttgccgtttgggcccaattcatttcattattcttcgaaatgatagcttcagacataaaattatgtctcaaagcttcttgagcatttagacgattagtttctgcattgtactgtccggtcgcagctttagtttgttcaatgccttcactaacacgattgtgtcgtgtagtttcactttcagtcgtcatattatgtctaatactttcagctaatttattagactcaatagtctcattagctacattagatctgtgacgttctgactcgtctgctgtattgtgacggttagtttcggtctcctgtgctaggttgtggcgattagtctcttgttcgcccaccatgttgtgacgcatactttcagctaaagtatttcgacctaaatcttcaccagcaaggttgtgtctttggctctctgacaactcattcctggcttgttcctcagcagccacattgtgcctctgagtttctaaattgcgaactgtttgaatgtattcgttcgctttgttagtgcgttcttgttcagcgttcgcacgatgctgtatcagatttctctgataattgatttgatttgcagtcatataaatacctccttaccacaaatcggccc

SEQ ID NO: 97 - DNA, 1290 bp, WUHARV Picobirnavirus 5 contig00107
gctggaactgcgagagacgctaatttatatgcataactgttgataaagtagcggaaatcggctaaattagcgataaagtcatcgtaatccaaagaaaatgcttccataattcctttaggataatatctgtttacctgagaaaataactgtaagcaaccatatgctctaaccatatatgcgtacattgcgtaagctgagtccattgataatatatataacattaaatcaggtgcatcatagtttgtatgccctgagttagcatgtctaacccaagtataaatctgtcttgctgcaacatttactggtgagtactggtctgtagcacagccaggagcgtctaaagttgcacaagccattacacccatgtcattaataccagcaagtatattggttaactcagtggttgtacgctgcaaatcaatctttgatcctgcaggatagaaatatgaaaatgatgctgcatcttttaagagctgatcattattattgtaccaattagggtcattaccaactttgttagagccagtgtcgcaaaaacgagagctaggtttagcagaatttcgcttactcttcgaattctgtctagatcgtttgttgttagatttttcacttgttgctttattgtagaaaccttctctactagtttcattagatctttctttgttttcattcttcataattttctccattctttctaattaatatacccgaatttgttataacgtgtagcagctgtgataatatcaagcccagcgccagcaaagtctttgaaacctctggcaatgttagcaaaaccaccagtgaatgcattagtagtttcgttaacgacatgtgcctgacctagctcgtaattattgttgacttcagtttcgcgagttgtggcgttacgcgcgttagtccaagcattaacttcagcaatatctgcttgcctggatccaattgtgaaatcgttttgagctctggtcattccaactgcgtatgacctatctgctgcatagcgtgtagctgcagcgttagccattccaacagagtaactaaccatgtttgattcatgcattaatccttctgttgcgacattgtgtcgattagtttctacttcaccgacaacattatgtctgttcgtttcaatttcggttgcgacattgtgcctatttagttctatttcgtaggctaagttgtgtcgctctgtttctttcagattctgataatcaatctgattgtgtgtcataaatgtttcctcctttccttatgacttctctgtttcctcgtctagtacccttttctccatcc

SEQ ID NO: 98 - DNA, 1234 bp, WUHARV Picobirnavirus 6 contig00044
ctgaaagacacaatcgtgtcacagaacgtgaacaagaacgttctaacagagctaatgagtctgaaaccttcagacacaattatgctactgaagtattaggttctcaaactctacaagaaagtaaaagacacaacatggctactgagagtaaccaattattgggaatctacgaaacatctagacataacagagttatggagcaaaatgatgcagtaaaagctacagcgtcaatgatatcagcaagtgcttcaagaactcaatcacaagctgcaatgctaagatctttatctgatgttaaatacgctggatacaatgctgaaacgtctcgaatctcagcttctgctgctaaatctaaagcagagagtgaagcaaaacgtgtatctatggagaaggactttcaaccattcagaaaatgggaatcaggaactaaagctttctcaaatgttttgaacagcctaactaatcgtagtgctgtcaaaagtcagaagtcagttaacagatcaatcaaatttaacaattatatgtctggttttaaatctatcggttcaacagtcactagtgttgccggtattctattaggtttaggaggttaaaatatgaatgaaaaacaaaatagaagaaacgaaaattatgaagaagataagtcaacaaacagaggatcaggaaaaggaaacaaatccaagagaggatttgctaagcgaggcaagtctatggattctgatcgcaatagaagtcgtgtgtctagcaattctggtaagaatggcaagtctaatatgaagaacgatgagtcttggtatttaagaaacccagagctaactcagactgctacagcatttaatttattatatcctactggtgtatctttcaacttattagattcacatgctactgtaggttcagaagctattaagatgaatcctactaatttagctggtgtgtgcgcatttagatacattccaagtattggttatgctgctagctcaacagacccggtaaatgttgcgacaactaagatatatgcatatgttagacatatgaatagtggtcatacaaattacgagtctgccgatttaatgttatatttattacaaatgagacaatgttactcatggtatatgtggatgacaagattatacggagtattaaattcatactctgctctaaacagaaatctaccaaaagcattggtagcggcaatgggcgtgaactatgatgatgtaatttcaaacatgcc

SEQ ID NO: 99 - DNA, 1168 bp, WUHARV Picobirnavirus 7 contig00065
tacccgctgaatgcagctacccccggaggtatgatttttcgaatatcacaccgttcctggtattgcgaccgaccgagcttcggctattaacgtagctgctaataatatttatcagtatgttagacatgctaactctggtcatactaattatgatcctcaggattatatgctttaccttttaggtatggattccctttatgcgtattatgcatggatgattcgtatctacggtcttgctcaggcatattctatgactaatagatacgtgcctaaaactcttcttcagtctctgaatatagactgtgacaatatacagaaacatggaaatgatctcctgtattttatcaacaacgcagcgcggaaaatgaattctttcgctgtgcccggaggaatgagctattatgaaaggcatatatggcttaactctcatgtttgggctgacgatacgtccgaaaaggctcagtactatatgtataatcctagcggattttacaaatttgaagaagtcgcgagcaccaaaggtggtaaactgagttacgttcgtatggatgaactcgtaggaggaactaaaggtacactttatactatagagaatatcgcgaaaggttttaataccttgtatgatgccataatggctagtgaagactgcggtattatgatgggtgatacccttaaggcctttggttctaatatcatccaggttgcgcctgtagattctaactaccaggtatttcctgaatataatgaggaagtgcttggccagatccacaatatcgagacaacaggaactctcctgtcggattctgtcgaacaggatccggataagaatatgttggtttgcagacctaacgctagtacaagtgctttggatggacttgaacacttgcttgattgcaaatctagtgcgccagatggtgctaccattatggttgacacaagactcaaaccaatagttgagcgtctcggtgatagtcaaacgaccaacacactaaccagttgtggttctgaagtggtcgaaatggtcaaaatgttctacaactgttttgacagagagggagtttctaagtttaaggaggacagattcccactgaatggcatcctctatgtgccaaacgatgctacaattatgcaagccgttgcttctctgacgcagcgttgcgacagactc

SEQ ID NO: 100 - DNA, 7273 bp, WUHARV Enterovirus 1 contig00002
atggtccaaattaatcaactcaattttaaggtttcaaaaagattcaagccaaattctcctcagattatcgtactgaggaatcgacagtactttgccaattggtactgttctaatcttttcaacaaattcattgtactcctcccttccagcgtgccaagccaagagacacagtgaacgcacgtgatcttgggtgttacgcgcatccttagtccagcggatggactcgtgtatctctgacataggcataaccgggtggatcaagaatggaaattgctcatctggtttgaaactcctctttaaaaatgttgcattctcccaagtgacctcgttgaagcaagaggatttgtctgcaggtgtcatgaccaagccatactccctaccagttcttgccaattcagcgcaatcaattggaaatgggtaactagctagcacatcatctccatatgcaatcatgttcaattcatccaaatcaatgcccttgaatgttctaatcaagagggttctaataataatattgttgatcatgctattgaagatgctagttccagagcaaccagagggcataccaccaactacacaatatgttttattacggtaaatgtggtgtgaatgattgatgccctcaatgaggctgatagcctcatcatcatagcctaggtctctcaagactatttctagtgctctaaaccacgctgggctcaagctagcgtcatatccggtgtaatcaaaagcaaacaaactacctggaaggaggatggggattttgctccagaaggtatcaggatttgctcccactgcagagcctgtgatggtgcctgggttctcatgaaacttttcaaacaggcgtccaaagcacattctcatgtacacagaatcattcaagcttgatgcctcaatcagtctggatttccctttcttcactttctcactgcttctcagttcatccttgatgtacgttgagaagggcaggtctaacccgtacttgtccatgtaatacttcattttggtgacatctctggtggtagggtctaatatctgtcttttcttaatacccagagcattgtaagggtatcctgcactggtactcaggtcaattgcctccagattttctgtcccgtagcaagcatcttccatactcatcctgctagtgtcaatgttaagttgctttagttggtttgagtaatgtttggctgcttgaatgatatattcatcaggttcatgaatggcattaccaatgtacttgctaaacaaagcttcctcaaagtcaacttccaacctcgggtcctttgcactaagtgctgcaggctccttcttaccctcaaacacatcatgaaacacactgggttcaagtttggtctgggttggaccattgatattgtagcggccagtttccttattgggtttcatccattggatctcaccctgctcggtggcaaaatagcttctctttaatgccgcacagaacccttgctttccattgcctccaacatgaattccaatcactttcccagtacttgtgactactccaccacactgaccagctttggttgggaagttgtacatcattgttctgtgtgttggttttccactcaggttgaggaaaccataaaattgaacgtcccccacagggacgaacattgatggcatctgctctgtgttgatgatgagagtggcatccatacagtgttcaaatgattcaggaataaacttggtgatgtctctgaatttctcgttcatatccaatgtaactagagtgagttctaggtttacttgttgctcatcaaccagttcaacagcgtctaacactgtcacctgcttgccttccatccaaatggtcttaccaggtttcgcatgtcttgggagcactgccaacctgtctctaactccaagcatagtgaaatgcccttcttctgtctgtatctttctaatgttctttttaagtagagaaatagcaaaatctagtcctggaccttgtgccactgctgttctcaagactggtttctttaccgctgtttttggcattccagaataggctccctggaatccagcaaacaatctgtaaatgacatataccatagacaccacagccaggatggtggtaatagattggataagtgcaatggccctgttatagtgcctttcgaggtttgttggtacttcaggaattatccaccccttctctttacagtattctctgacttcctcattatctacacttctcaagaggtctgcaatagcttctggggctggtgtgtccaaggaaattgtgagaggcctgaatttaggtgggccttggaacagtgcttcaattgtgtttccaactgacattctgttgttgtattctctgataagttctgagatcactgaatccaaactgtatctcacctttgattttctgtctcttaattggatggctttaccacagactagtgggctgcaccttttaaagtttgcagtgttgttctctgagcacaactttgccgctctaccggcatctagcttgccattttccaatctaaagctgtctggaacctcgatgtcacagtccatgtaaaatcttcttctaatagcttcagagtcggacacagttggtacgatgatgttaccagagttggtggatgcaataacaaattttgaattaaatgcaatacctttctcttctaatgaggccattggtggaatgaattcaactgtggagaccatttgacaaaagagagagatgtcttttccatctgggttttgacacaaatcatccataactgtaactacctgttgcttgtatccatcaaagtggtctgggtctggtggcagtgagtacacactagagttaaacttctcagcaatagccctggcaatgatactggttgctagagattttcccgtaccaggggagcctctaatgatcaaacatacaggttcaatacgttgtttgcccttgaactgcatgtaattgaccattctcttctccattgagaagactctcttggcctcagctgcataaagtggttggaatttcctgcaattgattgctaaatactggatgtttccaaataattgttccaagctctcttgacttgcagcagcttgttctaaattgttgatctggttctctaacaaaggaagttgcttaaggttattgataaattcagccttctctcttgcaatgggtatgattttctctcttatccaatcaatgaatttgctgattttgttggctatccactcaagaccacgggctgcattggccatgtcattgaatttctttagccaagagtcagattgcttctgggcaatggggatgcccaggatggaagcaacttttgtcttgagccacctccacggactacctgtgcaaccaatcaatgcaagtgttgctgtgactgtaaccaaatcatattcactcctcacaattatgactagagctgatattaatttaacaagatttttcaagatcttctcaaccacaccttctgatccaataagcgtgtccttgatgttctggacctccctggcaatggattctgtaaagccagtcccaaaagcatcacccaagcctttaatgtagtctgtgacaccttgttccatcacttcatcttcaagccacaggaggtccctgatatcagcaaacccaaccagtccatcaccgcccatggtgaccaatccaatcacaccgtgagggcacctcaagatgccaccacaatcgcctgccacagcgattccatttgccaataggacatgagactggtatctctcaggatagtactcatttgcctggacgtggacaagccccggaccttggaaggagactgcataatgcttgcccattgacttgcagaagtatacacctgtgctacagttacatctggcaatcttatcgcatccatgggcagatgttctagaaacaaggatgtctctctgataatcctcccactcaaggttgtcccaatcatgcttggtggccaggtgtctgttaacaattctgtagttgcacacatacactgccccactctgttgaccaaaggctccggttgtggttatgcttttcctatctttggccatgtgcttgatgttgttgccattgaaatttggataattttttagtatgtatggctgggtcctcattggccttgggatccatgccctgacatgtttgattctcatgtagattctgacagtcagtttcgttgtcacattctcggaaccaactaccctgaaagcaaatgtaccgaagaggttattggggctgatgccatagttgatgtcaccagatgcagggtggctgccaaatgtgggatatccatcatagaaccactgatacgctgatgctggcgacatgaatgggacagatacttgtgcgggagggtcagacgccttgacaaagacagatggattagtggcagactgccattcaaatgagtcccttgtagtgggcgcaggggcacctggagggatgtacatgtattgaactaccacgttaggcccctgtccggtggagtcagtgcagacaaaagtaaattcagagtcaaatctcatgtatgtaaagatctctaatttcctccgttgctgtacatagcccattatgtcaattggccagtttgtgaagccatttgcagtagattcagatgtgagcagggttgtcatcccgacaagagcagctctgccaaagaagttctctagactagtttcagcaacactgtgatgattgtgaacacatcttgtttctatcatggactcatcagaggtgactgatgttgcacctgtttctgctgcctggagtgctggtgcagaccctgttgtgagactgtgtgaacttgcatcggtgtcagctccagtacttgttgatccgccgttgacattgctaaggactttgtgtgcagtggaattgatgtgagtctctagcatatccttaatgtcaccttgtagcacagcagtttgagaaatctcgtcagtgtctttgcatagtctcatggtgaagtttggctgagcagcacccagagctataaggtaggcactggttggagcgcccgatggaaccacaaaatttgtttgataccaaatggtgactatacctgcggtgtaataatcaaagtaagttcccgcggcatttgttctgaagtgtgtgttactaatccaggggataactagtgttatggatgactgaagaccaaaatcccaaattacatgggtgcctagcattgctgtggcccgatctcggggttgcgtcccgccggggggtgtgtaagctattaaaagctttcccgtagccatgaaactacctgtgaacataaaagtgacttccagtgaacctgaccactgtgtgtaatatctacacagttggcctaccattgtagattgccatgggccgtcacgacctgggtccaccctgaacgacgcacacaattgatctactgcactttgaactgacactggtatcaatagtctgttcatttgggccacagacgctacattgttgacttcaagtatgctttcaatttggcatagttgtagtagattatttacctctcctgggatgtggatcagtggtgttggatgaaagcctggaaggatgggtgcagacacaccgtcatctgtggtgaggaattggttgctgccaggtttcaattccactggtaaaccttgcgtgactgcatttctcaggccagcgaattcagcgcaaagtggcgcaatggtcactgttatgggcacagctgatgtagccccttcactaaaagctaatggggcaatggggatgacaaacaatccaaagttgcagtggttcagtgctgaatcatagggcactgcatttgcatagggcatgattatagtagcacagttgtttgttctaaggttgatccattggtgtggggcaacaagcaattgagagacagccactccacaatctaacacgtaagggaaggctaattcctttccatttggtccaggttgtgtagcttcgaatgatgggtgctttgcgtcggcaggtgtggtatttgcatcactcctaccatttgtgtattcaggtaagcatgctactaggagtgtaccctggtggaatttgcttgcgttgcactgcacatggacggcaaaacctgacctgtacaaatagtggaactgtgcattttgaccaaacacacctgtctctgttaagacgtcggggaacttccagtaccaacccttgctatttgattcccacaattttgctgctaaggtatagaatctgttaactgaaacatctggtcttgttggtttgtccacagcagttgcatcagtatcactgcaatactcaggccattcaccataacctactactacattagccgcctcttgtgttgtgatggtagagttcccaactgtcatttgacagaccctgtcgctgtaaccgcaagcctctgctgatggggacttgagtgggaccgatgactcttttagaacgtccaccactggttgagtgaatttacttgggtcttgactaaagtcctgcttgttagctgatgcagcgtaagaatccttgtaataattaatggtggtataatggatggtggacccgccggtggcaacgttggtgttctcatgagtaccagactgttgagtggatacttgagctcccatgatgatgctatgacctatgaaaattgcttgtgagcaagagataaatcacacaaagacaaatccggatggccaatccaatcgctatatgatgacaaccctagattgtcaccataagcagccaaaatgagtaaaacaggaaacacggacacccaaagtagtcggttccgccacagaattactcgttacgaccacaacgttactggattgtaacgcatggctccgtggttaggattagccgcattcaggggccggaggactactacctagctcaataggctcttcgcaccatgtcatgaatcaagcgtcctgcgggtgaaacccgcaggcaggccgccaacgcagccaccgacacggtcgcccgtggggaattcggtgactcatcgacctgaactacactggggttgtgctgaacgtaacacttgagacattcaatggtggtactaggcttctcgaagtaggtagccggataacgaacgttttccccttcagccgtgggtacagcctattggtactaagtccggggaaacagaagtgcttgacgaagactcacctggattggtgaatctgctagttgtcggttgtgttttcttctaacgttacgggggaagggagataaaacaggcatacaaaggtaccgtgataccagagtactaacgccgcgtgg

SEQ ID NO: 101 - DNA, 7128 bp, WUHARV Enterovirus 2 contig00002
cccagtaacgttagaagaaagtacaaatgacacttagcaaatccaccaacccaggtgggttttcgtcaagcacttctgtttccccggacctagtaccaataggctgtacccacggctgaaggggaaaacgttcgttacccggctacctacttcgaaaagcctagtatcatcatagaatgtctcaagtgttacgctcagcacaaccccagtgtagttcaggtcgatgagtcaccgaattccccacgggcgaccgtgtcggtggctgcgttggcggcctgcctgcgagtttcactcgcaggacgcttgattcatgacatggtgtgaagagcctattgagctaggtagtagtcctccggcccctgaatgcggctaatcctaaccacggagccatgcgtcacaatccagtgatgtcgtggtcgtaacgagcaattctgtggcggaaccgactactttgggtgtccgtgtttcctgttttatttaccttggctgcttatggtgacaattgtatagttgtcatcatatagctattggattggccatccggatatatacaagcaactagtgttcacactacctcttttgctataacacaagtatcatgggagctcaaatttccactcagaaaaccggttctcacgagaacgccaatctggcaactggtggttctaccatcaactacaccacaataaactactacaaggaatcctatgctgcgtctgctaccaagcaagactttagccaggatccatccaaattcactcagccagttgtagatgtgataaaagaatcatccgtaccactcaaatcaccttcagctgaggcgtgtggttacagtgatagagttgcccaattgacactcgggaactccacgataacaactcaagaagctgccaacataacagtgggctatgctgagtggcccgaattttgcccggacactgatgcaacagctgtggacagaccatcacgtcctgatgtttcagttaacagattctacacactcagtgctaagttgtgggaaaagacatcaaagggttggtactggaaattcccagacgtgctcacagaaacgggggtctttggccaaaacgcacagtttcactacttatacaggtcaggtttctgcattcacgttcagtgcaattccagcaaattccaccagggtactttactagtggccaccatccctgaattcctagtagctaggtcagacacagcaaccgaccccaccacagcaaagcacccctcgtatggggctgcgcaaccagggaagagcgggaaagagtttgcattcccttacgtcctcgattctggcgttccgttatctcaggcactcatttacccacaccaatggatcaacctaagaaccaacaattgtgctaccatagttgtaccttacatgaacgctgttccttacgatagtgcacttaaccattgtaattttggactggttgttataccggtggctcctctcaactacaacgcaggtgcaacaacagcaataccaataacagtcaccattgctccaatgtgttcagagtttggaggtctacgtaatgctgtcactcagggaattccagtggaattgaagccaggatctaaccagtttctaaccactgatgatgaagtgtctgtacccattctacccggatttcaccctacaccagagattcacattccaggtgaagtgaaaaacatgttagaaatagctcaagtagaatcaattctagaggtaaacaacctagagagtaatgagaatgaccctatgcagcgccttctcataccagtgagtgttcaatctgctgttgaccaactgtgtgctagtttccgtgttgaccctggtcgggcaggaccctgggaggcaacacttgtgggccaattgtgtcgttattacactcaatggtctgggtcgctagagattacatttatgttcactggatctttcatggcgacaggtaaaatgttgatagcttacaccccaccaggggctgctcaaccaacatcaagagagattgccatgcttggaacgcatgtgatatgggattttggtctacagtcatctgtaacgctagtcgtgccatggatcagcaacacacactatcgaacacaagcaaccaacaattattttgagtactactccagtggcatagtgacactatggtatcagactaattatgtcgtaccagacggtgctcctaccagtgcttacatcatagcattaggtgcagcccaaccaaacttctcattgaaactatgcaaagacaccgagtccattgctcaaacagccattctgcagggtgatccagagtcgtcgctggaaacattcgtggagggacaagttagtaaagcccttacagcagcagacaccaaaccaagtacacataagatctcaactggtgacacaccagccctgcaagcagcagaaactggagcaacatcaaataccagtgatgagaacatgattgagactagatgtgttgttaacaaacactctattgctgaaacctccgtacaaaatttctacggacgagctgcattggtagggtacatctcagtgctcacatcggacactacggcaaatggtttcactaactgggacatagatgtcatgggcttcgtgcagcaaaggagaaagctggaaatcttcacctacatgcgctttgatgccgaatttaccttcattgccactgctgatgatggacaagcagactccacaatgctacaatacatgtacgtaccacctggagcccctaaaccaacacaaagagattcatttgaatggcaatcagcaaccaatccatccatcttcactcgcatgacagacccaccagcacaggtttctgtgcctttcatgtcccctgcctcagcctatcaatggttttatgatggataccccactttcggacaacacaccgcaagtacggacagttggtatggggtgtgtccaaacaatctcatgggaacctttgctgtgagagcggtgggatcaggaaatatcaaggctaacatcagaattagagtttacatgagaatgaagcacattagagcttggatacctagaccattcagaagtcaaccctacctattgaaaaattaccccaacttcaacggtgcagctttgaagtgcactagtaaaagcagaacaagcataaccaccacgggtgcatttgggcaacagtctggagcaatctatgtctgtaattacagagttgtcaatagacacttagccactaaggaagattgggaaaaccttgtgtgggaagattatcagagggacctccttgtctcaaacaccaaagcacacggctgtgatatcattgctaggtgcaattgtcaaactggagtttatttctgtaaatctcaaggtaaacattacccagtcagcttccaagggcctggtttggttcacgtccaggagaatgagtactaccccgaacgttaccagtcacatgtgcttttggcgaatggcttctcagtagctggcgactgtggagggattctcaggtgtcaacatggtgtgattggtctcgtgaccatgggtggtgatggcctggtcggcttcgctgatgttagagatctactctggttagaagatgaagtcatggaacagggagtaacagattacatcaaagggcttggagatgcttttggaacaggctttacagaatccatcactagagaagttcaagcattgaaggaccatttgttggggtccgaaggtgttgtagaaaagatccttaaaaacctggtcaagatcgtgtcggcactggtcatagtaatcaggagtgactatgatttagtcacgatgactgcaacacttgctctgatcggttgtcacacaagcccatgggcatggttgaagtcaaaggtttgcagtctccttggtctccctattgcacaaaagcaaggggacaattggttgaagaaattcaatgacatggcaaatgccgccaagggcctggaatggatcgcagtcaagatctcaaaattcattgattggcttaagcaaaaagttgtaccagctgctagagaaaaagtggaatttcttaacaacctcaaacaactaccattactagagaatcaagttagtaacttggagcaagcagccgctagccaggacgatctggaagccctgtttggaaatgtacaatacctggctattcattgcaggaaataccagccactgtatgcctcagaagcacgtagaattgccactctagagcgtagggtcaacaactacatgcagttcaagaacaaacaacggattgaacctgtatgcttgatcatacgcggtgccccaggcactggaaaatcgcttgccacaggtatcattgccagagccattgcagagaagtaccattctagtgtgtactctttgccgccagatccagaccactttgatggctaccgtcaacaggtagtcactgtcatggatgacctgtgtcagaatcccgacgggaaagacatctccctattttgtcaaatggtctccactgtggaattcatacctccaatggcatcactagaagaaaagggtctaccctttacatccaaatttgttattgcctcaacaaactccagcaacatcatagtacccactgtctcagacagcgaagcgattagacgccgcttctacatggattgtgacattgaagttcctgaatcttacaggcttgagaatgggaaattggatgcttcaagggcagctagattgtgttccgagaacaacactgccaacttcaagaaatgcagtcccttggtctgtggcaaagccatccaattgaaagacagaaagtccaaagtgagatacagtctagattcagtagtctcagagctcattagagagtacaacaacagaaacagtgttgggaacaccattgaggccttattccaggggccacctgtgttcaaaccaatcagcatctctcttaccgagccagcacctccagccattgctgatctattatcatcagttgatagtgaagaagttagacagtactgcaaggataagggatggatcatcccagaggtgcctacaaacattgaaagacatgtcaatcgagcagtggttgtcctacaatccatcaccactgtggtagctgtggtatccctagtttatgttatatataaattatttgctggtttccaaggtgcctactctggcatgcctaaaacggctttgaagaagccagtattaagaactgccacagtgcagggcccttgccttgattttgctctctctttgctccgcagaaacatcagacaagttcagacagacaaaggtcatttcactatgcttggtgtgcgcgatcgcattgctgtgttgccacgccatgcagaaccaagtgggaccatctggattgaaggcaagcaagtcaaagtcttggatgctgttgagttggtggatgagcaacaagttaacttagaacttaccctagtcaccttagatatgaatgaaaaattcagggatatcaccaaattcattccagaggatatcgaaccagttgcagaagccaccttagtgatcaacactgaacagatgccttccatgtttgtccctgtgggaaaagttgagaattatggatttctgaacctgagtggtagaccaactcacagaacactcatgtacaacttcccaaccaaagctgggcagtgtggcggggtggtcaccagtgttggtaaaatcattggaatccatgttggaggaaatgggcgccagggcttctgcgcagccttgaagcgatgctacttcactacagaacagggagagattcagtggatgaagccaaatagtgagactggtagatacaacattaacggtcccattaacactaagctagaacctagtatcttccatgatgtgttcgatggcaagaaggaaccagcagcattatcttccaaggataagaggttggaagtggactttgaggaagctgtcttctccaagtacattggcaacaagattcatgaacccgatgagtacatgattcaagcagctcaccattatgccaaccagctcaaacagttgaacatagatacatctaggatgtccatggctgatgcatgctacggaactgaaaatttggaagccattgatctcagcaccagtgcaggctacccatacaacgcgctgggcattaaaaagaggcaaattctgaaccccgaaactcgtgatgtcaccaaaatgaaattctacatggataaatatggattggacttaccatattccacctatgtgaaagatgagttgagaagcattgaaaaggtaaagaaaggaaaatcacgcctcattgaagcaagtagtctgaatgattcagtttacactagaatgtgtttcgggcatttgtttgaagctttccacgctaatccaggtaccatcacaggatcagccgtaggttgtaacccagacaccttttggagcaagatccccattcttctgccaggatcgctttttgcttttgattacacaggatatgatgctagcttaagtcctgcatggtttagagctttagagatagtgctcaaggaattaggttatgattctgaagctgtaggtgtaatagaaggcataaaccactctcaccacatatacagaaataaaacctactgtgtgcttgggggcatgccatctggttgctccggcactagtgtattcaactccatgataaacaacatcataataaggactttactcatcagaaccttcaaaggaattgatttggatgaattgaacatgattgcatatggcgatgatgtcttagcaagctaccctttccctattgattgtcaagagctagcaaatactggaaaagaatacggtctgattatgactccggccgacaagggtagttgcttcaatgaagtgacatgggaaaatgccaccttccttaagagaggtttcaagccagatgaacagttccctttccttatccatccaaccatgcccatgtctgagatccacgaatccatcagatggaccagggacgcccgtaacactcaagaccacgtgcggtctctgtgcctcctggcatggcacaatgggaaagagatttatgatcaatttgttaggcagatcagatcagtgcccgttggattggcactatccataccagagtacaacaacctccg

SEQ ID NO: 102 - DNA, 6952 bp, WUHARV Enterovirus 3 contig00003
cgaagagcctattgagctaggtagtagtcctccggcccctgaatgcggctaatcccaaccacggagccatgcgctacaatccagtagcattgtggtcgtaacgagtaattctgtggcggaaccgactactttgggtgtccgtgtttcctgttttatttactttggctgcttatggtgacaatctagagttgtcatcatatagcgattggattggccatccggaaatatcttttgtgtgatttacctcttgctaccaagcaaatatcatttatcaaacaataatatcatgggtgctcaagtttctactcagaaaactggctctcacgagaatgccaacatggcggtcggtggttccaccatcaactacaccaccataaattactacaaggagtcctacgctgcttcagcaactaaacaagacttcagccaggacccatccaaattcactcaaccagtggttgacatgatcaaggagtcctctgtaccactcaaatcaccctcagcagaggcttgtggttacagcgatagagtcgcccaattgacactcggaaattccaccatcacgacccaagaagctgcaaacataacagtggggtatggcgagtggcctgaattttgctcaaacactgatgcaacagctgtggataaaccatcaaggccagatgtgtcggtgaacaggttctatactctaagtgccaaattgtgggaaaagacatctagtgggtggtactggaagttccccgatgtattaacagagactggggtttttggtcagaatgcacagtttcactacctatacaggtcaggtttctgcatacacgtccaatgtaatgcaagcaagttccaccagggaacactactagtggctgttattccagagtttactgtagccagatctgattcctcaactgaccctaccactgccaaacacccaagttatggtgcagctcaaccaggcaaaaatggaaaggagtttgctataccctatgttcttgactcaggtgtcccactgtcccaggcacttatctacccacatcagtggattaacctaaggacaaacaattgtgccacgatagtgatgccatacatcaatgctgtgccctatgatagtgctttgaaccattgtaactttggcctagccatcatccctgtggcaccacttgactttaatacaggtgcgaccacagctataccaatcaccgtcactattgctccaatgaattcggaatttgcaggccttcgtaatgctgtcactcagggtcttccagttgagctgaaaccaggttctaaccaatttctgactactgatgatgaagtgtctgcacccatcctgcctgggtaccacccgacgccggaaatacacattccaggtgaagtcaagaatctgttggagattgcacaagtggaatcaatacttgaggtgaacaaccttaccacgaatgagaacagtcctatgcagcgccttctcatacccgtgagtgtgcaatcggcagtggatcaattgtgtgccagttttcgtgtggaccctggtcgtgcaggaccgtgggagtcaacactcgttggtcaattatgccgttattacacccaatggtctggatcattggaagttactttcatgttcaccggttcattcatggcaacaggtaagatgttaatagcttacacaccaccaggtggtgcacaaccaacatcaagagagattgctatgctcgggacacatgtcatttgggattttggtctacaatcatctgtcaccatgatcattccatggatcagtaacacgcactaccgcacacaggcaactgacaaatactttgaatactacaccagtggaatagtgacattgtggtaccaaaccaactacgtcgtaccagagggtgcccccaccagtgcctacattattgcactaggagccgctcagcccaacttcacattaaagctctgcaaggacactgaatctatctcacagacagctattttgcaaggtgactcggaatcatcactggaggcatttgtggagggccagattagcaagactttgacagcagctgacaccaaacccagtagccacaacatttcaacaggcaacaccccagcactgcaagctgcagagactggagcaacatcaaacactagtgatgagggcatgattgaaacaaggtgtgtggtcaataagcattcagttgcagagacttctattgaacacttctatgggcgtgcagcgcttgtgggtatagtatccatactcacttcagaaactacaacaaatggtttcactaactgggatatagatatcatgggttttgtccagcaaagaagaaaattagagattttcacctacatgcgctttgacgctgaattcactttcattgctactgctggtgatggcaaggcagattccacaatgatacaatatatgtacatcccaccaggtgcacctagaccaacaatgagagattcttttgagtggcaatcagctaccaacccttccatctttgttagaatgactgacccacccgcgcaggtctccgtacccttcatgtcacccgcttccgcttaccagtggttctatgatggttacccaacatttggaactcacaatgcatccacagatagttggtatggagtgtgccccaacaacctcatggggaccttcgcagtaagagcggtagggtcaggtaatattacatctaacattacagtaagagtgtacatgaggatgaaacacgttagagcgtgggtaccaagaccacttagaagccaaccataccttttaaaaaactacccaaacatggatggcaggaacttgaagtgtgctagtactagcagaagcagtataaccactacaggggcctttggtcaacaatctggtgctgtctacgtcagtaattacagaattgtcaacagacacttggccactgaggaagattgggagaatctagtgtgggaagactaccagagagaccttcttgtttccaacaccaaagcacacggttgtgacaccattgccagatgcaaatgccagacaggagtctacttctgtaagtcccaaaacaaacattacccagttagttttcaaggccctggtttagtgcgtgtacaagcaaatgagtactaccctgaacgttaccagtcacatgtattattggctagtggtgtctcaaaagctggtgattgtggtggaattcttagatgccaacatggtgtgatcgggcttgtgaccatgggtggtgatggtctcgtcggctttgcagacattagagacctgctttggcttgaggatgatgtaatggaacaaggtgttacagattacatcaagggcctcggggacgcatttggaacaggcttcacagaatccatctccagggaagtgcaggcacttaaggaccaccttttgggatcggaaggaatagtggagaaaatcctcaagaacttggttaagatcgtgtcagcgctggtcatagtaatcaggagtgactacgatttagtcacgatgactgcaacacttgctttgatcggttgccacacaagcccatgggcctggttgaaatctaaggtgtgtagtttccttggtctcccaatagcacagaagcaaggagataactggctgaagaaattcaacgacatggcaaatgcagccaaaggcctagaatgggtagcaatcaaaatctccaagttcatagattggctcaaacagaaagttgtcccagctgctagagaaaaagtggaattccttaacaatcttaagcaattacccctgttagagaatcaggtcagcaaccttgaacaggcagcagccagccaagatgacctagaagccctctttggaaatgtgcagtatctcgccatccattgtagaaagtatcaaccattgtatgcttctgaagcacgcagaattgcaactctggagcgtagagtcaacaactacatgcagttcaagaacaaacaacgaattgaacctgtatgtttgattattcgtggtgctccaggtacaggaaagtcacttgctacaggcatcattgctagggctattgccgagaaataccactccagtgtgtactctctaccacctgaccctgatcactttgatggttatcgccaacaagttgtcactgtaatggatgacctgtgccagaacccagatgggaaagacatctccttgttttgtcaaatggtgtccactgttgagtttataccacctatggcatcattggaagagaagggcttgccctttacatcaaagtttgtcattgcctccacaaattctagcaatatcatagttcccactgtttcagacagcgaagcaattaggcgtcgcttttacatggactgtgacattgaggtcccagaatcttatagacttgagaatggaaaactggatgcctcgagagcagctagattgtgctctgagaacaacacagcaaattttaagaagtgcagccctctagtttgtgggaaagctatccagctgaaagataggaagtctaaggtgagatacagcttagattcagtggtttctgaactcatcagagaatacaacaatagaaatagtgttgggaataccatcgaagcccttttccaagggcctccagtgtttaagcccatcaagatatctctgacagaaccagcacctccggctattgctgacttattgtcatcagttgatagtgaggaagttaggcaatactgcaaggacaaggggtggatcatccctgatgtgcccactaacattgagaggcatgttaacagggctgttgcaatcttgcaatccatcaccactgtagttgctgtagtgtctttggtgtatgtcatctacaagttgttcgccggctttcagggtgcttactcaggcatgcccaaaactgctttgaagaaaccagtcctgaggacagccactgtgcagggaccttgccttgattttgctctgtcactactccgcagaaacataaggcaggtgcagactgacaaaggccacttcaccatgcttggtgtacgtgatcgcatcgctgtgttgccacgccacgctgaacctagtgggaccatctggattgaaggcaagcaagttaaagtcttggatgctgttgaattggtggatgagcaacaagttaacttagaacttaccctagtcaccttagatatgaatgaaaaattcagggatatcaccaaattcattccagaggacatcgaaccagttgcagaagccaccctagtgatcaacactgagcagatgccttccatgtttgtccctgtgggaaaagttgagaattatggatttctgaacctgagtggtagaccaactcacagaacactcatgtacaacttcccaaccaaagctgggcagtgtggcggggtggtcaccagtgttggtaaaatcattggaatccatgttggaggaaatgggcgccagggcttctgcgcagccttgaagcgatgctacttcactacagaacagggagagattcagtggatgaagccaaatagtgagactggtaggtacaacattaacggtcccgttaacaccaagctagaacctagtatcttccatgatgtgttcgatggcaagaaggaaccagcagcattatcttccaaggataagaggttggaagtggactttgaggaagctgtcttctccaagtacattggtaacaagattcatgaacccgatgagtacatggttcaagcagctcaccattatgccaaccagctcaaacagctgaacatagatacatctaggatgtccatggctgatgcatgctatggaactgaaaatctggaagccattgatctcagtaccagtgcaggctacccatacaacgcgctgggcatcaaaaagaggcaaattctgaaccccgaaactcgtgatgtcaccaaaatgaaattctacatggataaatatggattggacttgccatattccacctatgtgaaagatgagttgagaagcattgaaaaggtaaagaaaggaaaatcacgcctcattgaagcaagcagtctgaatgattcagtttacactagaatgtgtttcgggcatttgtttgaagctttccatgctaatccaggtaccatcacaggatcagccgtaggttgcaacccagacaccttttggagcaagatccccattcttctgccaggatcgctttttgcatttgattatacaggatatgatgctagcttaagtcctgcatggtttagagctttagagatagtgctcaaggaattaggttatgattctgaagctgtaggtgtaatagaaggcataaaccactctcaccacatatacagaaataaaacctactgtgtgcttgggggtatgccatctggttgctccggtactagtgtgttcaactccatgataaataacatcataataaggactttgctcatcagaaccttcaaaggaattgatttggatgaattgaacatgattgcatatggtgatgatgtcttagcaagttaccctttccctattgattgtcaagagctagcaaatactgggaaagaatacggtctgattatgactccggccgataagggcagctgtttcaatgaagtgacgtgggaaaatgccaccttccttaagagaggtttcaagccagatgaacagttccctttccttatccatccaaccatgcccatgtctgaaatccacgaatccatcagatggaccagggacgcccgtaacactcaagaccacgtgcggtctctgtgcctcctggcatggcacaatgggaaagagatttatgatcaatttgttaggcagatcagatcagtgcccgttggattggcactatccataccagagtacaataacctccgacgtctctggttggaacaattttaaataggtttaaatatgaataaaagaaatttgaattaaattcggtttaattcggcctcctcaatggctctgggctagttgtggccattgaggaacaatagtcttaacccagta

SEQ ID NO: 103 - DNA, 344 bp, WUHARV Picornavirus 1 GZXIHWF01C8JTK
ctatgccttgatatttcctgatcccacggctctcacagcaaaggttcccatgagattgttgggacacaccccataccaactgtccgtacttgcggtgtgttgtccgaaagtggggtatccatcatagaaccattgataggctgaggcaggggacatgaaaggcacagaaacctgtgctggtgggtctgtcatgcgagtgaagatggatggattggttgctgattgccattcaaatgaatctctttgtgttggtttagggccccaggtggtacgtacatgtattgtagcattgtggagtctgtcttggtccatcatcagtcagtggcaatgaaggtaaattcggc

SEQ ID NO: 104 - DNA, 8059 bp, WUHARV Sapelovirus 1 contig00001
tatatcatccaattagccaaattaacaagaaccaattcaaccaaattcaagttaaacaccatattataactaattagaacaagtcaagccagttatatctaagcacctcgaaagatggcaaagacaaagctcgcccaaccggagtactgcggattttctcgcaaaactcctcataaacttctttcccattgtgccaagccaataggcacaatgaagtcacatgttcctgtgtagttgcagcacttctagtccatctaatagactcatgaatttcagacattggaaacacaggatgacagagaaagggaaattgatcatcaaagacaaaagatctcttcaagaaagtaacttctgttaacttactacaaccattaaaagaatcagatttatcagctggtgtcattgtaaggcctaactctttgcccgcatcagcaagcactgcagggtccaaaggaaatgggtatgaaactagcaaatcatctccataagcaagaattcttagtaaatctagattgattcctttataacatttgagaactaaagtcctaacaactaaattattgataatagaattaaatatggaggttcctgaacatccagatggcatacctccatgaacaacataatattgatctttaaaaatatgtgatgaatagcagatatgatctatagcatctatagcaccttcaccataccctaacttaactaagaacactttaagagcatcaaaccagaaaggagacaaagaagcatcccagttagtataatcaaaagcacagatattatccgtgcctatctcagaagcaaactgagaccaatgataatcaggattacaacctacagctgatccagtacatgtgccagggttagaatggaaagtctgaaataatctaccaaagatcctcttcatcctaatagtatcattgagagaactacattcaattaatctggtcttccctgcttctacttttgccttgggtctaagttcatcttttaagtaagtggagaagggtaaattgtagccatgcaaatcaagagctttctgtaattgtgttaatggctcacctctgagtggaatcagatctctcttccttatccccattgtattataaggatacccagcagatgtgttcaaatccaaaccctctaaattttcaaccccataaaccacatcttctaattccaattgttcagtaagattctctggtagaagcggcctaatctgttctacataatgatctatagcaataaatgtttctggagggatggaaatatgtttattacctttatattttgcaaaaagggcttcattcaaatcaactttaaggcggctatcaccaggcctcagagctgcaggctcttttgtcccttcaaagacatcatgaaacacagaggggtacaatccagtcttagtcttaacattaatagatttaacacctttttccttggttgattctttatgtacaatttcaccttgacacacactaaaataggacttcttcaacattgcagagtaacctgaaaccccatcaccaccaatatgcattcctaagattttccctgcttttaccactattcctccacactgaccgacttttgtggggtaattatacttaagggtattatatgtagcagtcatggatagattgaggaaaccaaagagggaaacagatccaactgggatatagacatcccggaactggtcagaattcaaggcaagccaacattctttttctgtatggaaattctcaactaaatatttcctaatatctctgaacttctcattcctatctaatttaacaacaactaattctaaattacctctactagattcaagaagcatagaatcaagaatatttacactttcacctttgaacactatagtatcctttgggtttgcgtgagcaggaaggactaaccattggtcaaataaacctaatgcagtataagatccagttgaggtacagactgggaaaagggaagttttcataagtgacttagcaaactcaagatctggtccctggacaacagctttcctaagaacaggtttttgaatgactggctttatatttcctgtgtaagcaccctgtttgccagcaaaaacactcacaagcatatatacaacagttgagaaggaaacaattgtagttagggtagacataacagttgtaaaccaattaagatacttctgcaccttatttctttctctaacaacctcaacctcaatggggaacacataacctttctccttcaacttagctatgagctcttctgatggaacttctttcaacacctcaacaacttcctctggtaggagtttatcaacaacctgtttcctgatgagctttggcttctcatagctaggaccctggaataaagcatcaaccacattgagtatgtttctcctccttcttgactcagcaagcataatagtaacaaccttatctaaagtgtacctaacatttgtcctcctatcttgtaaaagtatagccttaccacatattaaaggattacaacatttgaaattctctggcttgggacagtttaaacaaggggtgcatttagacatatccaatttcctatcaatagaaaagtccttgcctactataatgtcacaatcaagataaaacctcctttgcaaggcagcaggttccataacagttgggggtttaagtgaagagcaattggtagatgcacacacgaagttagaagtaaagtatgtacccttctcttcaagggaagccataggaggaatgaaagcagtagttgaaaccatttgacaaaacaaagacatatcttctccatcagggttttgacctaaatcatccataacaacaacattttgctgggaataaccatcaaaatacttggggtctggggggagggagtatggaagttgggtatcagtagcctgagcaagggatctggaaataacttcagtagcaatagatttacccgtcccaggggagccatgaatacagagagcaacaggttcatatctagaagacctaatagactgggccaacttttgtgcttttgcatggtactttacaatttgtgttgtagccatatttctctcgataccataggtatcagccaatttcttaattgtaataacaaattcacaaacttccaggacatcagcatcatggtaattcttcctgtttctttctattagatccatcttttccattacttctggccagtcttcaagcatcctatgaaattcaagtcttgctggatcatcatttttcttcagaagtccttttatccaatcaaagaatgttgataatttctggtaaatatactctaatcccttaaaagcattacaagctatgttaaaatctttaagccaatcactagggccttgcatttgaacacatccagtaaatttttcataaaggtaagtgaatgggtctttggaaagaaaatcaacacctaacatactgccgagagcaagcagagttgaaagcttacattcatctttggcatttatatacactacaagagagcctatcactttaacaaggatagaaaatagggaattgaaaagtttatccttcaaaaatccttcaacacctcctttaaactgagagacaataggagttattttctcaatagcttcatccacatttctctgaaaggattctcctgcaccatcaccaaaagaaatacccatttcatgtatccaatcatataaaccttgatagtgagcctctgggaaagttaaggggatttcatcatcaagatcatcagggtaccctgtattagctccaaaaggatcttccaaacctaattgtatggcaggctcatgctgaatggcataaaaacagtcttgttttgtaacctcaacacacctatagaaagaagctgtatctaattgtgtaaagaaagtagtcattactttatcaccattatcatatgtacacattgatttagctgtgagcatacctatagctttaccctcagaaaaaagcatactcccacagaagcctggttcagcatcaccacggcatgaccaaaggtctttctgttgatgatctctaaaatttaatatttcacagtattggggatttctatattcagtatacctaacagggaatacaacagaattagtcacacacaaacaatgctcaaatttcctttcattcttatgcctaactctattctcacctattaaacctggtctagcttttattctattagaagggataacccggatgaaggcgatgtcgcgaaatgaatcaatccacacttgtttcacaccaacggcttcaaccaggtaagggttcttccaccacctagaagttgaacaagaaattctatatctgaatactggattcttcctctctaaatacttataccagtcattacaagcatgataagaagtgatgataatgtcatccttccaccaccaagcagtgaaaggacctttatcaaattgagcagaaaaagataaaacatcatagcacctttctaacaatatatcagttggactcatgttaacccaatcaaattcatcaacattccacatgtctcctattggtgatttaatatccacatcatactcaaaccctaattgtgtagtaccaacagttgtgtatctagtgtaatcttctactactgtaccatccctatatgccaaaaggggacgaggcatataagcttggatattgactggtcttacatatattctaacaccataggatccagtgaaatttggcactgtatcattaatcatttttattgtgatattaccaataaaattgcctgggttcacaccatattttttatcattaggatcaaatgcaccagaaccattatatcttgatgtgtaataattgcacactgacataaaaggaatgcggaaagatgtgggtgggtcctgaattttggatattacagttgggttaataggggacaaccatactttggaatcataagattctggcacttcacacccagcaggtgaaaacatgatttggaatgtcatagattgtggggaggtattattattaatttggggataaatcactacacacacatctaaatcaaatctccaatatgtaaatgctctccacctagtgattgcaggatcagaagcagcaacagcatcaaatgtaatttccttattaatcatgggtgttaatccttcagtggtagcttttgttattgtgactgtgccctgataatacatgaagtacctggagtacaagtattccaaatctgtctccttggtggaaaatactacatttgtctccctaagctccatagtggactcaccagaactaccagaggtttcacctgtctccgcagcagtcaatgcagcagagtcaccctgtgagatttctactccattatgtttaatttctttttgaggtgatgtactaagggcattctctatgtgtgtattcacagatgcttgaagagctttaagaactttatcttcctctccttgtctattaacattattagtataatatttattatcagaagggattctaaaaacaaagttatcagaagcactaactaaacctataatttgacatatattgggggcacctgggggaacaactattgctgtttggtaccacattgtaatccacccatcataagaaagagtagtatttgttaacatactagacctatatgcagaagttgaaatataaggtataacaaacttgacagtggattgtagacccacatcccatatcacatgtgtccctaacatagcctcttccctatttgcggggcttgacccacctggtggtgtatatgcaattaagaacttgccagttgccatttttgagccacagaacataaattcaatttcaacactacctctataatttgcatacatctttgccaatctccctaggtatgttggtttaaacatgtcacccactaatgacatgtcccattttccaattgcgttggtatggaaattctgtgttacatctacagctagatatgttccatctgcttgggtatttggcattttcatcatagttgggacacgggctacctccaaaaggttgtttactctacctggcaaaatgaaattctttgtcttctggaattctgggtacaaggggattccagcatctctttgaactgtaaggaattgaccactacctgggattaacctaacggggataccttgggttttaacagcagaccttaatcctgcaaatgatgaacacataggggcaacactaacagtaatagggacaactgtagaggcaccagtattatatgaaaggggaaccactactctaatgaccaaggtaacaaagttatgagacaaaccaaatccagagggagtacaattagtgtaaggatagacaatagtagccgaattatttgtcctaatattaataaattgatgagggaatagggttaattgctctgttggatattcagtaccacacatatccttatgttcccaataagcaaaatcatttggttgctctttcggagtttgatgttctgggatcatagcaacgaggagacatccttgatgaaattgagaagcattaacctgaacatgaacacagaaacctgatctatatagataatgaaatctaagattttgaccgaacacaccagtgtccattaaagccccgggaagaggacaaacccattcaccatattgagtgtctttccaatcaagagaatcaaaagtatagaatcggtcacatgatggaccaggtttggtatctaaatctaaagcttcacctgcatcaatgttatatgtgggccacattccataagctacaacagccttagctgcctcctgagttgtgatacatgaattacctgatgttaactgcatcaatctatcagagtaacctgcttcctccacatttggggatttgagggatggtcctttcaaacttcctgcaatttctgtcactggttttgtaaatttttctgggtccataacttgttgtgaagggttataagcctgggaataatcactgccataataattgatgttagtaaggtggtttccagttccataaatataacctgaggagggcttattgcctgtctgatttgactgtacctgtccacattgaaagatttcttccatctcaactatacacctaccatactttgtgacaatctcatctctcctaacaaatttggtttctcctttatgtttgtgcacatagagatatccatcatccgctaaggtgacaagcggtccaggtgacatctcaactttggaggccttactcctgggcttttgcttccttactttgttgcgacgattccgaggaatccagttacagcattgtactgactccgaggagtcatcctcatagattgccatcttagagaatgtcttgttgaggggggagggggttttaaagcaatccatgggggattactactggttataccatacacaaacgaccagccgcggccctgtcaggtagcactagactaagtagagggggcccccccctctagatacaccttggagtaatgccatgagcatgcgccatacgcctcaccctcgggacagaggggacgcattcgtcaaggactctaatgaacattcgggctaagaaattcttttccctttgcctccagatgcctctagctctttcgtgtacggtcgtgttgggtgaaagcaaaaaacagcatactccctgttgttcctagacttacttcggcccgcacagcgtagacctaggatgttctaggcaggtttcaactgccaatgactaacatcacttgccacaattgccttttatcctgggcggccaaccctgaaatcataatccaaagagtaaccattaaactgtccatacggctagcgcgcaagacgccaactcttggtcataacaggtccaatccatagaatatgtcttcatttttcccctgaatgagtaacaggtttgaattcataaaccattattcagtctaaaccgtaataccagtccgtttgggtggggatgggtataaggtaaggggatacaacaccactacaatagatccttggccctagctcccgtaagagaaggggtgggggttgcctaagtagggt

SEQ ID NO: 105 - DNA, 8025 bp, WUHARV Sapelovirus 2 contig00001
acaccatattataactaattagaacaaatcgagccagttgtatctaagcacctcgaaagatggcaaagataaagctcgcccgaccggagtactgcgaattttattacagaactcctcatagatctcttttccattgtgccaagccaataggcacaatgatgttacatgttcctgtgttgttgcagcacttctagtccatctaatagactcatgaatttcagacataggaaacactggatggcaaagaaagggaaactgctcatcaaaaacaaaagatcttttcaagaaagtaacttcagttaacttactacagccattaaaagaatcagatttatcagctggggtcattgtaaggcctaactccttgcctgctctagcaagcacctcagggtccaatggaaatggatatgaaacaagcaaatcatctccataagcaaggattcttagtaaatctaaattgattcccttataacatttaagaactaaagttctaacaactaaattattaataatagaattaaaaatggaggttcccgagcatcctgatggcatacctccatgaacaacataatattgatctttaaaaatatgagaagaataacaaatgtgatctatagcatctatagcaccttcaccatatcctaacttaaccaaaaacaccttaagggcatcaaaccagaaaggagataaggaagcatcccaattggtataatcaaaggcacaaatattatccatacctatctcggaagcaaattgggaccaatgataatcagggttacatcctacagctgatccagtacaagtgccaggattggaatggaatgtttgaaataacctaccaaagattcttttcatcctaatggtgtcattgagggaactacattcaatcaatctagttttccctgcttcaactttggctttgggtctgagttcatcttttaggtaagtagagaaagggagatcataaccatgtaaatcaagagctttttgcaattgtgtcaatggctcacctctgggtggaattaaatctctttttcttattcccattgtgttgtaagggtacccagcagaggtattcaaatctaaaccctctaggttttcaattccataaactacatcttccaattctaactgttcagtaagattctctggtaaaaggggtctaatttgctctgcataatgatctatagcaatgaaagtttcaggagggatggaaatatgtttattacccttatattttgaaaagagagcctcattcaaatcaactttgagacggctatcaccaggcctgagtgctgcaggttcctttgttccctcaaaaacatcatgaaagactgaaggataaagtccagtcttggtcttaacattaatagatttcacacccctttccttggttgtctctttgtgtacaatttcaccttggcagacactaaaataagacttctttagcatagcagcatagccagagactccatcaccaccaatatgcatacctagtattttacctgccttcaccactatccctccacactgtccaacttttgtagggtagttatatttgagggtattatatgtaggagtcatggaaagattaagaaacccgaagagggagacagaaccaacagggacatagacatcccgaaattgatcagaattcaaagcaagccagcactccttttctgtatggaagttttcaactaaatattttctaatatctctaaatttctctgttctatctaattttactacaactaattctagattacctctactagattcaagaagcatagagtctaagatttttacactatcacctttaaacaaaatactatctttagggtttgcatgagcaggaagaactatccattgatcaaataaacctaatgcagtgtaagaaccagttgaagtacaaacagggaagagagatgttttcatcagtgatttagcaaactcaaggtctggtccttggacaacggcttttctaagaacaggcttctgaataacaggttttatgttcccagtataagcaccctgtttaccagcaaagacactaacaagcatatatacaacagttgagaaagacacaattgtggtaagagtggacataacagttgtaaaccagttcaagtatttctgcactttgctcctttccctcacaacttctacctcaatggggaacacataacctttctccttcaacttagctatgagctcttctgacggaacttccttcaacacttcaaccacttcctctggcaagagcttatcaacaacctgctttctaataagctttggtctctcataactaggtccctgaaataatgcatctaccacattgagtatatttcttcttctccttgattcagcaagcataatagtaacaatcttgtccagggtgtatctaacatttgtttttctatcctgtagaaggatagccttaccacagatcaaaggattacaggccttgaaattttctggcttaggacaattcaaacagggggtacacttagacatatctaatttcctatcaatagaataatctttacctactacaatatcacaatcgagataaaatctcctttgtaaagcagctggttccatgacagttggaggtttaagcgaagaacagtttgtggaagcacacacaaagtttgaagtgaagtaggttcctttttcctcaagggaggccattggaggaataaaagcagtggttgaaaccatttgacaaaacagtgacatatcttcaccatcagggttctgacctaaatcatccataacaacaacattttgctgggagtaaccatcaaagtacttaggatctgggggaagagaatatgggagttgcgtgtcagtggcctgagcaagagatcgggagatgacttcagtagcaatagatttacctgttccaggtgatccatgaatacaaagggcaacaggttcatatctggatgacctaatggattgagccaatttttgtgcttttgcatgatatttgactatttgtgtagtggccatgtttctctcaataccataagtatctgccaattttttaattgtaataacaaactcacaaacttctaaaacatcagcatcatgataattctttctgtttctctctattagatccattttttccatcacttctggccaatcctctagcatcctatggaattcaagtctagctggatcttcatttttctttaggagcccccttatccaatcaaaaaatgttgacaatttttggtaaatgtattccaatcccttaaaggcattacaagctatattaaaatcttttaaccaatcacttggcccttgcatctgcacacatccagtgaacttttcatacagataggtgaaagggtctttagaaagaaaatcaacacctagcatactgccaagggcaaggagagtagaaagcttacattcatccttagcattgatgtatattacaagggaacctattactttcacaagaatagaaaagagagagttgaagagcttatctttaagaaatccttctacgccccccttgaactgggagacaatgggtgttattttttcaattgcctcatccacatttctctggaaggattctcctgcaccatcaccaaaggaaatacccatttcatgaatccaatcatatagaccttgataatgggcttctggaaaagttagaggaatgtcttcttcaagatcatcggggtatcctgtattagctccaaaaggatcctctagacctaactgtgtagcaggttcatgttgagcggcataaaagcaatcttgttttgtcacctcaacacatctatagaaggaagctgtatctagttgtgtaaagaaagtagtcatagtcttatcaccattatcatatgtacacaaagacttagctgtaagcatacctatagccttaccatcagagaaaagcatactaccacagaatcctggctcagcatcaccacggcatgaccataggtctttttgctggtggtccctaaaatttaagatctcacaatattgggggtttctatattcagtatacctaacagggaacacaacagaattagttacacacagacaatgttcaaattttctttcattcttatgtctaaccctattttcacctactaaacctggcctagcttttattctatttgaaggggcaacccggatgaaagcgatgtcgcgaaatgaatcaatccacacttgtttcacggcaacggcctcaaccaggtaagggttcttccaccacctggaagttgaactagagattctatatctaaaaactggattcttcctttccaaatacctgtaccaatcattgcaagcatgataagaggtaataataatatcatctttccaccaccatgcagtaaagggacctttatcaaattgagcagaaaaagataatacatcataacatctttccagcaggaaatctgttgggcccatgttcacaaaatcaaaattatcaacatcccacatatctcctattggtgattttacatccacatcatactcaaaccccaactgtgtggttccgggtgttgtgtacctggtgtaatcctctaccacggctccattcctatatgccagaaggggtcgaggcatgtatgcttggatgttaactggtctcacatatatcctaacaccataggctccagtaaatgtgggtactgtatcattaatcatttttattgtaatattgccaataaaattacctggattaacaccatacctcttatctgcaggatcaaatgaaccagaaccattgtacctagaagtataataattacacactgacataaagggtatgcgaaaagaagtgggagggtcttgaatctttgaaattacagtaggattaatgggtgacaaccacactttggaatcataggactcaggtacctcacacccggcaggagagaacataatttggaaagtcatagattgtggggaggtgttgttattaatttgaggataaattactacacacacatctaaatcaaacctccaatatgtgaatgccctccatctagtaattgcagggtcagaggcagtgacagcatcaaatgttatttccttgttgatcattggagtcattccctctatggtagcgtttgtcactgtgactgtgccttgatagtacatgaaatatctggagtacaagtattctaaatctgtttccctggtagaaaataccacatttgtttccctcagttccattgtagattcacctgagctaccagaggtctcacccgtttccgccgcagtgagagcagcagaatccccttgtgaaatctcaaccccatcatgtttaacttctttttgtgttgatgtattgagggcactctctaggtgtgtattaacagatgcttgaagagccttaagaattttgtcctcctccccctgtctattggcattatttgtgtaatatttattgtctgaagggatcctaaaaacaaaattatcagatgcactaaccaaacctataatctgacaagtggatggggcatttggcgggaccactattgcagtttggtaccacattgtgatccaaccatcataggagagagtagtatttgttaacatactagatctataagcagaggttgaaatataagggatcacaaatttgacagttgattgcaagcccacatcccatatcacatgtgttcctaacattgcttcctctctagtttctggacttgatccacctggtggtgtatatgcaattaaaaatttaccagttgccatctttgacccacagaacataaattcaatctctacactacctctgtaatttgcatacatttttgccaatctccctaagtatgttggtttgaacatatcacctaccaaggacatatcccactttcctattgcacccttgtggaagttttgtgacacatctacagccaaatatgtgccatccgtttgtgtgtttggcatcttcatcatggttgggacacgagctacttccaaaagattatttactcttcctggtaaaataaaattttttgtcttctggaattcaggataaaggggaataccagcgtccctctggactgtgagaaattgaccactacctggaatcaacctaacggggatcccttgtgttttgacagcagatcttagccctgcaaaagatgagcacatgggagcaacactgacagtaattggaataactgttgaagcacctggactatatgaaaggggcaccacaaccctgataaccaaggttacgaagttatgagacaagccaaatccagagggggtgcaattggtgtatgggtaaacaatagtggcagagttatttgtcctgatattaataaactgatgaggaaacaaagtcaattgttccgtcgggtattcagtgccacatatgtccttgtgctcccaatatgcaaaatcatttggttgttcttttggggtttgatgttctgggatcattgcaacgaggaggcatccctggtgaaattgagaggcatttacctgtacatgcacacagaagcctgatctatatagataatggaatctaagattttgaccgaacacaccggtatccataagagaaccggggaggggacagacccattcaccatattgagtatcctgccaatcaagagaatcaaatgtgtaaaatcggtcacaagatggaccaggtttggtatccaaatcaagggcttcaccagcatcaatattgtatgtgggccacatgccataagccacaacagctttggctgcctcttgggttgttatacacgagttacctgaagtcaattgcattaacctatcagaatagcctgcctcttctacatttggggatttgagggatggtcctttcaaactacctgcaatctcagtgactggttttgtgaatttttctgggtccatcacttgctgtgaggggttataggcttgggagtagtcactaccatagtagttgatgtttgtgaggtgatttccggtcccataaatgaaacctgaagagggtttgttacctgtctggtttgactgcacctgtccacattgaaagacttcttccatctcaattatacacctaccatactttgtaataatttcatcccttcttacaaatttagtctcccctttatgcttatgcacatagagatatccgtcatccgctaaggtgacaagcggtccgggtgacatctcaactttggaggccttactcctgggcttttgctttctttcttttttacgtcgattccgaggaatccagttacagcattgtagtgactccgaggagtcatcctcatagattgccatcttagagaatgtcttgtgaagggaggagggggagttaaagcaatccatgggggattactactggttataccatacacaaacgaccagccgcggccctgtcaggtagcactagactaagtagagggggcccccccctctagatacaccttggagtaatgccatgagcatgcgccatacgcctcaccctcgggacagaggggacgcattcgtcaaggactctaatgaacattcgggctaagaaattcttttccctttgcctccagatgcctctagctctttcgtgtacggtcgtgttgggtgaaagcaaaaaacagcatactccctgttgttcctagacttacttcggcccgcacagcgtagaccttagatgttctaggcaggtttcaactgccaatgactaacatcacttaccacaattgccttttatcctgggcggccaaccctgaaatcataatccatagagtaaccattaaacagtccatacggccagcgcgcgaagcgctaactcttggtcgtaacaagtcaaatccatagagaatgtcttcatttttcccctgaatgagtaacaggtttggattcatcaaccattattcaatctaaagccataataccagtccgcttggatgggatgggtttaaggtaaggggatacaacaccactacactagatccttggccctaactcccgtaagagaaggggtgggggttgcctgagtagggtgagggggcgaaatgagtgtga

SEQ ID NO: 106 - DNA, 6872 bp, WUHARV Sapelovirus 3 contig00002
cgctttacgcgctggccgtatggactgtttaatggttactctatggattatgatttcagggttggccgcccaggataaaaggcaattgtggtaagtgatgttagtcattggcagttgaaacctgcctagaacatctaaggtctacgctgtgcgggccgaagtaagtctaggaacaacagggagtatgctgttttttgctttcacccaacacgaccgtacacgaaagagctagaggcatctggaggtaaagggaaaagaatttcttagcccgaatgttcattagagtccttgacgagtgcgtcccctctgtcccgagggtgaggcgtatggcgcatgctcatggcattactccaaggtgtatctagaggggggggccccctctacttagtctagtgctacctgacagggccgcggctggtcgtttgtgtatggtataaccagtagtaatcccccatggattgctttaactccccctcctcccttcacaagacattctctaagatggcaatctatgaggatgactcttcggagtcagtacaatgctgtaactggattcctcggaatcgacgtaaaaaagaagaaagcaaaagcccaggagtaaggcctccaaagttgagatgtcacccggaccgcttgtcaccttagcggatgacgggtacctctatgtgcataagcataaaggagaaactaaatttgtaagaagggatgaaattattacaaagtatggtaggtgtatagttgagatggaagaagtctttcagtgtggacaggtgcagtcaaaccagacaggtaacaaaccctcttcaggtttcatctatgggaccggaaatcacctcacaaacatcaactactatggtagtgactactcccaggcctacaacccctcacagcaagtgatggatccagaaaaattcacaaaaccagtcactgagattgcaggtagtttgaaaggaccatccctcaaatccccgaatgtagaagaagcaggctattctgataggctaatgcaattgacatcaggtaactcatgtatcacaacccaagaagcagccaaagctgttgtagcttatggcatgtggcccacatacaatattgatgctggtgaagcccttgatttggataccaaacctggtccatcttgtgaccgattttacacatttgattctcttgattggaaagatactcaatatggtgaatgggtctgtcccctccccggtgctcttatggatactggtgtgttcggtcaaaatctcagatttcattatctatatagatcaggcttctgtgtacatgtacaggtaaatgcctcccaattccatcagggatgcctcctagttgcaatgatcccagaacatcaaaccccaaaggaacaaccaaatgattttgcatactgggaacacaaggacatgtgtggtactgaatacccgacggaacaattgactctgtttcctcatcagtttattaatattaggacaaataactctgccactattgtttatccatacaccaattgcaccccctctggatttggcttgtctcataattttgtgaccctggttatcagggttgtggtgcctctttcgtatagtgtaggtgcttcaacagttattcctattactgtcagtgttgctcccatgtgctcatcttttgcagggctaagatctgctgttaaaacacaagggatccctgttaggttgattccaggtagtggtcaatttctcacagtccagagagacgctggtatccccctttatcctgaattccagaaaacaaaaattttattctaccaggaagagtaaataatcttttggaagtagcccgtgtcccaaccatgatgaagatgccaaacaaacagactgatggcacatatttggctgtagacgtgtcacaaaacttccacacaggtgaaataggaaagtgggatatgtccttggtaggtgatatgtttaaaccaacatacttagggagattggcaaaaatgtatgcaaattacagaggtagtgtagagattgaatttatgttttgtggatcaaagatggcaactggtaaatttttaattgcatacacaccaccaggtggatcaagtccacaaaatagagaggaagcaatgttaggaacacatgtgatatgggatgtaggtttgcaatcaactgttaaatttgtgattccttatatttcaacttctgcttatagatctagtatgttaacaaatactactctctcctatgatggttggatctcaatgtggtatcaaactgcaatagtggtcccaccaaataccccaaccacttgtcagattataggtttggttagtgcatctgataattttgtttttaggatcccttcagacaataaatattacacaaacaatgccaacaggcagggggaggaggacaaaattcttaaggctcttcaagcatctgttaacacacacctagagagtgcccttaatacatcaacccaaaaagaagtcaaacatgatgggcttgagatctcacaaggggattctgctgctctcactgcggcggaaacgggtgagacctctggtagttcaggtgaatctacaatggaactgagggaaacaaatgtggtattttctactagggaaacagatttagaatacttgtactccagatatttcatgtactatcaaggcacagttacagtgactagcgctaccattgagggaatgactccaatgatcaataaggaaataacatttgatgctgtcgctgcctctgaccctgcaattactagatggagggcatttacatattggaggtttgatttagatgtgtgtgtagtaatttaccctcaaatcaataataacacttccccacaatctatgacttttcaaatcatgttctcgcctgcagggtgtgaggtacctgagtcctatgattctaaagtgtggttatcacccattaacccaactgttatttctaagattcaagaccctcccacttcctttcgtataccctttatgtcagtgtgtaattattatacttctaggtacaatggttctggttcatttgatcctgcagacaagaggtatggtgttaatccaggtaattttattggcaatattacaataaaaatgattaatgatacagtaccctcatttactggagcctatggtgttaggatatatgtgagaccagttaacatccaagcatacatgcctcgaccccttctggcatataggaatggagccgtggtagaggattacactaggtacacaacagctggaaccacacagttgggttttgagtatgatgtggatgtaaaatcaccaataggagatatgtgggatgttgataattttgattttgtgaacatgggtccaacagattacctattggaaagatgttatgatgtcttgtctttttctgctcaatttgataaaggtccctttactgcttggtggtggaaagatgatattattattacctcttatcatgcttgcaatgattggtacaagtatttagaaaggaagaatccagtttttagatatagaatctctagttcaacttctagatggtggaagaacccttacctggttgaggccgttgtcgtgaaacaagtgtggattgattcatttcgcgacatcgctttcatccgggttgccccttcagatagaataaaagctaggccaggtttgttaggtgaaaatagggttagacataaaaatgaaagaaaatttgaacattgtctgtgtgtaactaattctgttgtgtttcccgttaggtatactgaatatagaaacccccaatattgtgagatcttaaactttagggaccaccagcaaaaagatctatggtcttgccgtggtagtgctgagccaggattctgtggtagtatgcttttctctaatggtaaggctataggtatgcttacagctaggtctatgtgtacatatgataatggtgataaggtcatgactactttctttacacaactagatacagcttccctatatagatgtgttgaggtgacaaaacaagactgcttttatgcaattcaacatgaacctgctacacagttaggtctagaggatcctttcaaagctaatacaggataccccgacgatcttgaagaagacattcctttaacttttccagaagctcattatcagggtttgtatgattggattcatgaaatgggtatttcttttggtgatggtgcaggagaatccttccagagaaatgtggatgaagcaattgaaaaaataacacccatcgtctctcagttcaaggggggcgtagaaggatttcttaaagataaactcttcaactctctcttttctattctcgtgaaagtaataggctcccttgtaatatatatcaatgctaaggatgaatgtaagctttccactctcctcgctcttggtagtatgctaggtgttgattttctttctaaagatccttttacctatctgtatgaaaaattcactggatgtgtgcagatgcaagggcccagtgattggttaaaagattttaatatagcttgtaatgcctttaagggattggaatatatttatgcaaaattgtcaacattctttgattggataagggggctcctgcagaaaaatgaagatccagctagacttgaattccataggatgctagaagattggccagaggtgatggaaaaaatggatttaatagaaagaaacaggaagaattatcatgatgctgatgttttagaagtttgtgagtttgttattacaattaaaaaattggcagatacttatggtattgagagaaacatggccactacacaaatagtcaaatatcatgcaaaagcacaaaaattggctcaatccattagatcatccagatatgaacctgttgccctttgtattcatggatcacctggaacaggtaaatctattgctactgaagtcatctcccgatcccttgctcaggctactgatacgcaacttccatattctcttcctccagatcctaagtactttgatggttattcccagcaaaatgttgttgtcatggatgatttaggtcagaaccctgatggtgaggatatgtcactgttttgtcaaatggtttcaaccactgcttttattcctccaatggcctcccttgaggagaaaggaacctacttcacttcaaattttgtgtgtgcttccacaaactgttcttcacttaaacctccaactgtcatggaaccggctgccttacaaaggagattttatctcgattgtgatattatagtaggtaaagattattctattgataggaaattagatatgtctaagtgtaccccctgcttgaattgtcctaaaccagaaaatttcaagacctgtaatcctttaatctgtggtaaggctatccttctacaggatagaagaacaaatgttagatacaccctggacaaggttgttactattatgcttgctgagtcaaggagaaggagaaatatactcaatgtggtagatgcattatttcaggggcctagttatgagagaccaaagcttattagaaagcaggttgttgataaactcttgccagaggaagtggttgaagtgttgaaggaagttccatcagaagagctcatagctaagttgaaggagaaaggttatgtgttccccattgaggtagaggttgtgagggaaaggagcaaagtgcagaaatatttgaactggttcacaactgttgtgtccactcttaccacaattgtgtctttctcaactgttgtatatatgcttgttagtgtctttgctggtaaacagggtgcttatactgggaacataaaacctgtcgtccagaagcctgttcttagaaaagccgttgtccaaggaccggatcttgagtttgctaaatcgctgatgaaaacatctctcttccctgtttgtacttcaactggttcttacacagcattaggtttatttgatcaatggatagttcttcctgctcatgcaaaccctaaggataatattttgtttaaaggtgatagtgtaaaaatcttagactctattctccttgaatctagtagaggtaatttagaattagttgtggtaaaattagatagaacagagaaatttagggatatcagaaaatatttagttgaaaacttccatacagagaaggagtgctggcttgccttgaattctgatcagtttcgggatgtctatgtccctgttggttctgtctccctcttcgggtttcttaatctttccatgactcctacatacaatacccttaaatataactaccctacaaaagttggacagtgtggaggtatagtggtgaaggcaggtaaaatattaggtatgcatattggtggtgatggagtctctggctatgctgctatgttaaagaaatcttattttagtgtctgccaaggtgaaattgtatacaaagagacaaccaaagaaaagggtgtgaaatctattaatgttaagactaagactggactttatccttcagtctttcatgatgtttttgagggaacaaaggaacctgcagcactcaggcctggtgatagccgtctcaaagttgatttgaatgaggctctcttttcaaagtataaaggtaataaacatatttccatccctcctgaaactttcattgctatagatcattatgcagagcaaattagaccccttctaccagaaaatctcactgaacagttggaattggaagatgtagtttatggaattgaaaacctagagggtttagatttaaatacctctgctgggtacccttacaacacaatgggaataagaaaaagagatttaattccacccagaggtgagccattgacacaattgcaaaaagctcttgatttacatggttatgatctccctttctctacttacctaaaagatgaactcagacccaaagacaaag

SEQ ID NO: 107 - DNA, 327 bp, WUHARV Polyomavirus 1 GZXIHWF01EDJUF
caggaggcaagtttgtatttgctaacggtgttccctttacatcttcaataacacacatatatttatctattgcacagcctagctcaaagtttattttgtccccaggacaattgacatttaatgatacaccacttaacaggtctagtatagctgcagccaaagttgtttttccactattaattggacctttaaataaaatatttcttctttttggaacattgtttactaaaattgtaagcatttctttaaccttagttgtaactgaggtaataggcaatctagccaggccaccgcccccagtaattgggttatctccacccctccatc

SEQ ID NO: 108 - protein, 129 aa, WUHARV Adenovirus 1 contig00001_10
DGAMADQHIYVHLLGRRAFLPQQQGYSNMYVLFSPEDFVLAPRGIILLSLQLSLDIPTGYLGRFFSVADMNVRGVLLCAQEIQPSTWWEVSVVLFNHSDEFYRGSRGQPVACLLLERVIYPTVRQASLV

SEQ ID NO: 109 - protein, 132 aa, WUHARV Adenovirus 1 contig00001_14
VNMYLSRPIFFAVHIPAQLLQYLHGLNIEVLDFLKEQLSDFWLNILHCVTPIHQFCYSGAVLVSLAPSLELLCCIATPDLVPSAELTDLVGADLFNYLQMTLRMEIRDRGEQPDLGLLNLLQVSQEPDILQS

SEQ ID NO: 110 - protein, 134 aa, WUHARV Adenovirus 1 contig00001_20
PGSVKSAAGVSGARYLAVMMVCLRMAIEGALSELFNMHGMNLQTICRDIIREWRNENYLGIVQSCSLMIEEFDNNAFALLVFVEVRVQALLEAAIDSLENRIMFDLAVKFHQGSGGDRCHLRDLHFDPLVNRLE

SEQ ID NO: 111 - protein, 125 aa, WUHARV Adenovirus 1 contig00001_24
IAWNNMPLPCLPPPPVCRDRSGCLSWLELALTTCLELYRDICRFEVCIAPEAERDLCGLQEWLHFALRRERERRRDRRYLETCWQRTWFCYYKYEEVRRSLVYDATRQTVSLQTGSLQLSPATTL

SEQ ID NO: 112 - protein, 322 aa, WUHARV Adenovirus 1 contig00001_35
GGSVSDAGTGVTWRRAGSGRGSATTSTRKCVGPWSTMQRDRRYRCRLAPYNCHQLPPCEDRGSAVVEESSRYLECENMNMHNVSEVRSIPSCISFIVLQEWPVYWDCILTAWEKHVMKMYMKVCICCATLDLDFHQTIRGYERWIIHCHCNSPGSLQCRAGGAVLANWFKMAIYGSLINVRFPWYRQVVNRGLPREVLYAGSMFVRGRHLIYVKVRLDGHAVALLERMSFGWSVFSYGIMNNLIVMVCDSCRNLSEIQMRCCARRTRRLMIHAVRLLDNLTSYQPHRSRTERFRQRHLRGLVEHHRTFTLSEFDRGDNPWRA

SEQ ID NO: 113 - protein, 70 aa, WUHARV Adenovirus 1 contig00001_38
GGMQFFTETLENLPQGFVSITDRHLITKETVWILTPKYRTGSQQFTAMKGERLVYAVKWKGGGSLTVRVK

SEQ ID NO: 114 - protein, 69 aa, WUHARV Adenovirus 1 contig00001_92
TGLKSSSTLVLFIYEKMKIVGEDKEVDTNISFRVWRKFATHYRIPYESWEEGKVVLLNDVTRKLLSNLR

SEQ ID NO: 115 - protein, 28 aa, WUHARV Adenovirus 1 contig00001_144
MTNSGVQLAGGSRYARYRGRAAPYSPGV

SEQ ID NO: 116 - protein, 133 aa, WUHARV Adenovirus 1 contig00001_149
HDQLWGTISGRVQVRQVQRSGRSLLSGSIKRVIIRGRGIQLNDEAVSSSTGLRPDGVFQLGGAGRSSFTTRQAYLTLQSSSSQPRSGGIGTLQFVEEFVPSVYFNPFSGSPGRYPDAFIPNFDAVSESVDGYD

SEQ ID NO: 117 - protein, 112 aa, WUHARV Adenovirus 1 contig00001_154
IRGRLRLMTDGAAVRARLRHLHHCRQPRCYAREAIVFSYFELPDEHPQGPAHGLKLEIENALESRLIDAFTARPLLVETERGITTITLFCICPTPGLHEDLCCHLCAQFNKN

SEQ ID NO: 118 - protein, 192 aa, WUHARV Adenovirus 1 contig00001_161
KPNAGSLPSPCSASAPRPDYMKICVVIFALSLIKTELFAAPSTPSVISTTKSSSGKGTQTVFYSNSTSSIVLNCACTNELIQWIANGSVCKYFWGNEIVSRNNSLCKHCNSSTLILYPPFVTGWYMCVGSGLNPSCFHKWFLQKETLPNNSVSFFTLSYCCSPSGYSFKPLIGILALILIIFINFIIINNLQ

SEQ ID NO: 119 - protein, 275 aa, WUHARV Adenovirus 1 contig00001_168
QLTVNMLVILLLATFFALSHARTSIVGAGYNATLQSAYMPDSDQIPHITWYLQTSKPNSSFYEGNKLCDDSDNRTHTFPHPSLQFECVNKSLKLYNLKPSDSGLYHAVVEKSNLEVHSDYIELMVVDLTPPKCEVSSSYLEVQGVDAYCLIHINCSNSKYPARIYYNGQESNLFYYLTTSAGNGKQLPDYFTAVVEFSTYRETYAKRPYNFSYPFNDLCNEIQALETGTDFTPIFIAAIVVSLITIIVSLAFYCFCKPKKPKFEKLKLKPVIQQV

SEQ ID NO: 120 - protein, 104 aa, WUHARV Adenovirus 1 contig00001_172
TKTCHSTSVILFSSMVAAFLLLLCLPIIFVSSTFAAVSHLEPECLPPFDVYLILTFVCCISICSIACFFITIFQAADYLYVRIAYFRHHPEYRNQNVASLLCLA

SEQ ID NO: 121 - protein, 124 aa, WUHARV Adenovirus 1 contig00001_178
IQKSKRCLLTLFGMIKLLLILNYLPLINCNCPFTKPWSFYTCYDKIPDTPVAWLYAATAALVFVSTCLGVKLYFILHTGWLHPREDLPRHPLVNAFQLQPLPPPDLLPRAPSIVSYFQLTGGDD

SEQ ID NO: 122 - protein, 130 aa, WUHARV Adenovirus 1 contig00001_182
ATFNSPVEMTDSQDINISVERIAAQRQRETRVLEYLELQQLKESHWCEKGVLCHVKQAALSYDVSVQGHELSYTLPLQKQTFCTMMGSTSITITQQAGPVEGAILCHCHAPDCMSKLIKTLCALGDIFKM

SEQ ID NO: 123 - protein, 363 aa, WUHARV Adenovirus 1 contig00001_197
MKRTRVDEDFNPVYPYDTTTTPAVPFISPPFVNSDGLQENPPGVLSLRIAKPLYFDMERKLALSLGRGLTITAAGQLESTQSVQTNPPLIITNNNTLTLRHSPPLNLTDNSLVLGYSSPLRVTDNKLTFNFTSPLRYENENLTFNYTEPLKLINNSLAIDINSSKGLSSVGGSLAVNLSSDLKFDSNGSIAFGIQTLWTAPTSTGNCTVYSEGDSLLSLCLTKCGAHVLGSVSLTGLTGTITQMTDISVTIQFTFDNNGKLLSSPLINNAFSIRQNDSTASNPTYNALAFMPNSTIYARGGGGEPRNNYYVQTYLRGNVQKPIILTVTYNSAATGYSLSFKWTALAREKFATPTTSFCYITEQ

SEQ ID NO: 124 - protein, 587 aa, WUHARV Adenovirus 1 contig00001_215
KVCNPNNFVLLHYRTIKPCTPPFRFFQMKRARVDEDFNPVYPYDPPHAPVMPFITPPFTSSDGLQEKPLGVLSLNYRDPITTQNGSLTVKLGNGLTLDNQGQLTSTAGEVEPPLTNANNKLALVYSDPLAVKRNSLTLSHTAPLVIADNSLALQVSEPIFINDKDKLALQTAAPLVTNAGTLRLQSAAPLGIADQTLKLLFTNPLYLQNNFLTLAIERPLAITNSGKLALQLSPPLQTADTGLTLQTNVPLTVSNGTLGLAIKRPLIVQDNNLFLDFRAPLRLFNSDPVLGLNFYTPLAVRDEALTVNTGRGLTVSYDGLILNLGKDLRFDNNTVSVALSAALPLQYTDQLRLNVGAGLRYNPVSKKLDVNPNQNKGLTWENDYLIVKLGNGLGFDGNGNIAVSPQVTSPDTLWTTADPSPNCSIYTDLDAKMWLSLVKQGGVVHGSVALKALKGTLLSPTESAIVIILHFDNYGVRILNYPTLGTQGTLGNNATWGYRQGESADTNVLNALAFMPSSKRYPRGRGSEVQNQTVGYTCIQGDLSMPVPYQIQYNYGPTGYSFKFIWRTVSRQPFDIPCCFFSYITEE

SEQ ID NO: 125 - protein, 173 aa, WUHARV Adenovirus 1 contig00004_12
SFLLRAAAMRLVPEMYGVFCSETVRNSDELLNTDLLDVPNSPVASPPSLHDLFDVEVDPPQDPNEDAVNSMFPECLFEAAEEGSHSSEESRRGDELDLKCYEECLPSSDSETEQTGGDCCTEPVVKNELVLDCPDQPGHGCRACAFHRNASGNPETLCALCYLRLTSDFVYSK

SEQ ID NO: 126 - protein, 73 aa, WUHARV Adenovirus 1 contig00004_17
CFTGDVSDTEGDGDRLGSANSPCTLGAVVPVGIIKPVAVRVSGRRYAVEKLEDLLQEEQTEPLDLSMKRPKLT

SEQ ID NO: 127 - protein, 177 aa, WUHARV Adenovirus 1 contig00004_22
MGSESTAALMDLLGNLREFDVVRRLLELASDKTSRLWRFWFGSTLSSVVYRVKREQEAQFARLLAETPGVLVALDLGHHSLFQEKIIRNLTFSSPGRTVASAAFVAYILDQWSNSNSHLSWEYMLDYMAMALWRAMLRRRVCIYLRAQPPRLDRVVEENEPEETENLRAGLDPPVED

SEQ ID NO: 128 - protein, 521 aa, WUHARV Adenovirus 1 contig00004_36
AVGRDSWSSCGSGSRPSLSFSRKNHQKLNFFVSWPHGCFRSLCCLYFGSMEQQQQPPVVGVHAGLHGDGSVEGHAAEEGLHLLAGAASAAGPSGGGERAGGDRESESRPGPSSGRLGAEDDPEEGTSGGARKKQKTEPEPRNFLNELTVSLMNRQRPETVFWAELEDEFKKGELNLLYKYGFEQLKTHWLEPWEDMEMALDTFAKVALRPDKVYTIRRTVNIKKSVYVIGHGALVQVQTPDRVAFNCGMQSLGPGVIGLNGVTFQNVRFTGDDFNGSVFVTSTQLTLHGVYFFNFNNTCVESWGRVSLRGCSFHGCWKAVVGRIKSVMSVKKCIFERCVIALAVEGYGRIRNNAASENGCFLLLKGTASVKHNMICGSGLCPSQLLTCADGNCHTLRTVHIVSHSRRTWPTFEHNMLMRCAVHLGARRGVFMPYQCNFSHTKILLETDSFPRVCFNGVFDMSMELFKVIRYDETKSRCRSCECGANHLRLYPVTLNVTEELRTDHHMLSCLRTDYESSDEE

SEQ ID NO: 129 - protein, 177 aa, WUHARV Adenovirus 1 contig00004_40
GRTTTCCLACVPTMNPVMRSEVRGGATKGIKGHEGWTRCFKMSGTTDGNAFEGGVFSPYLTSRLPSWAGVRQNVVGSTVDGRPVAPANSATLTYATVGSSLDTAAAAAASAAASTARGMAADFGLYNQLATAAVASRSLVQEDALNVILTRLEIMSRRLDELAAQISQANPDTASES

SEQ ID NO: 130 - protein, 79 aa, WUHARV Adenovirus 1 contig00004_67
RALWNLDPADFLVAGVGPTFAVGHQPVGVQGREGSVLPGSQRSGEGGLGDGEGMSPGLGACEGALQAHPAGAEAGVVSL

SEQ ID NO: 131 - protein, 142 aa, WUHARV Adenovirus 1 contig00004_72
VGQIATKHEVVAEGLGRVSLGAQLSLGNVLTFGAVQTLEGVEFGGQEDRLGRVGVGSALSADGLALHQPRELGFSGIKNQVASIFFDAFLTLRLHESVSRFRDKKAVGVPVDRLEGAIFQRCSEVFRVQELGPLRDKGSGPG

SEQ ID NO: 132 - protein, 154 aa, WUHARV Adenovirus 1 contig00004_88
PGPEPLSRSGPSSCTRKTSEHLWKIAPSSRSTGTPTAFLSRKRDTDSWRRKVRNASKKMEATWFLIPLNPSSRGWWSARPSALSAEPTPTRPSRSSWPPNSTPSSVCTAPNVSTFPRESCAPRDTRPSPSATTSCFVAIWPTHRETTPASAPAG

SEQ ID NO: 133 - protein, 383 aa, WUHARV Adenovirus 1 contig00004_90
VQLNIAAKERADREKNQTLRSIAKLLSNALYGSFATKLDNKKIVFSDQMDPSTIKSIAAGHVNIKSTSFVETDNLSAEIMPAFERAYSPEQLALVHSDAEESDGESGHAPFYTPWGGAGHVTYTYKPITFVDAEEDDLCLHTLEKVDPLIENDRYPSQIASFVLAWTRAFVSEWSQFLYAEDLGTPLEDRPLKSVYGDTDSLFVTEAGHRLMETQGKKRIKKNGGNLVFDPAKPELTWLVECETVCAQCGADAYSPESVFLAPKLYALKCLHCTKCQHVSKGKLRAKGHAAESLSYDLMLRCYLADSQGDDARFSTSRMSLKRTLASAQPGAHPFTVTETTLTRTLRPWKDRTLAALDAHRLVPYSESRPNPRNQEVCWIEIP

SEQ ID NO: 134 - protein, 518 aa, WUHARV Adenovirus 1 contig00004_107
TRAHVAGGVRDRLRSVRSRRLLARVGLPGPQTLRPQVSALHQMSARFQGKAARQGTRGRVPQLRPHASLLSGRLTGRRRPLQHQQDEPEAHPRKRPARGSSLHRHRDHPHPNAETLEGQNPRGPGRPPAGALQRKSAQPPQPRSLLDRDSIEHVTELWDRLYLLRQSLEKMPMADGLKPLKHFNSLEELLSLGGERLLQNLVSENKHVRSMMNDVAPLLRPDGSCSSLNYQLQPVIGVIYGPTGCGKSQLLRNLLSTQLINPPPETVFFIAPQVDMIPPSEIKAWEMQICEGNYAPGPDGTIIPQSGTLLPRFVKMAYDELTLEQNYDVSNPQNVFAKAAARGPIAIIMDECMENLGGHKGVSKFFHAFPSKLHDKFPKCTGYTVLVVLHNMNPRRDLGGNIANLKIQAKMHIISPRMHPSQLNRFVNTYTKGLPLAISLLLKDIFQFHAQKPCYDWVIYNTTPEHDALQWSYLHPRDGLMPMYLNIQAHLYRVLENIHKVLNDRDRWTRAYRAKKNK

SEQ ID NO: 135 - protein, 146 aa, WUHARV Adenovirus 1 contig00010_71
SCRALWATTCVSTGLALDSTALTSTQIFSPWPTTRLPPWRPCCATTPTTSPSTTTCAQLTCCTPSPRTPPACPSLFPLATGQLLGAGVLPALKPRKLPRWAPVLTHTLSTPAPFPTWTAPFTSTTLLKRCPSCLTHRSAGPATTAC

SEQ ID NO: 136 - protein, 795 aa, WUHARV Adenovirus 1 contig00010_80
ANGGTAKTNSFAQASYIGMGANLTTNGIQVAVDTNNANAAVYANKIYQPEPQVGTSQWNINPTQNAAGRILKPTTPMQPCYGSYAYPTNENGGQVKITDGSTDPTGANSVSMEFFTTTADNQNQAKVVLYSEDVNLEAPDTHLVFKPDVADNAKAAETLLGQQSAPNRPNYIGFRDNFIGLMYYNSTGNMGVLAGQASQLNAVVDLQDRNTELSYQLMLDALGDRSRYFSMWNQAVDSYDPDVRIIENHGVEDELPNYCFPLNGQGISNTYRGLSVQNGQNTWQANNNAAENNEISIGNIFAMEINLAANLWRSFLYSNVALYLPDSYKYTPDNIELPTNQNSYGYINGRVTAPNAIDTYVNIGARWSPDPMDNVNPFNHHRNAGLRYRSMLLGNGRYVPFHIQVPQKFFAIKNLLLLPGSYTYEWNFRKDVNMILQSTLGNDLRVDGASVRFDSINLYANFFPMAHNTASTLEAMLRNDTNDQSFNDYLCAANMLYPIPANATSVPISIPSRNWAAFRGWSFTRLKTKETPSLGSGFDPYFVYSGSIPYLDGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQVVDSVNYANYKEVKMPFQHNNSGFVGYMGPTMREGQAYPANYPYPLIGATAVPSLTQKKFLCDRVMWRIPFSSNFMSMGSLTDLGQNMLYANSAHALDMTFEVDPMDEPTLLYVLFEVFDVVRIHQPHRGVIEAVYLRTPFSAGNATT

SEQ ID NO: 137 - protein, 95 aa, WUHARV Adenovirus 1 contig00010_81
PLRWIPWMSPRFSMFCLKSSTWCASTSRTAASSRPSTCAHLSLPVTPPPKEANGLQRTGAAGHCSRPGLRALLFGHLRQAVPRLYVPPQAGLRHR

SEQ ID NO: 138 - protein, 105 aa, WUHARV Adenovirus 1 contig00010_83
PHLLPVRPFWFLRRKAEADLPIRVRGAPQAQRSGLHARPLRHPGKVHPDGPGAPLGRLRAFLLHVFARLRALASQPHGAQPHHGSAHRSAQQHASQPPGRPHPAP

SEQ ID NO: 139 - protein, 197 aa, WUHARV Adenovirus 1 contig00010_84
RHHLKKPMGSSEQELQAIVRDLGCGPYFLGTFDKRFPGFMSPHKPACAIVNTAGRETGGVHWLAFAWNPRNRTCYLFDPFGFSDERLKQIYQFEYEGLLKRSALASTPDHCVTLEKSTQTVQGPLSAACGLFCCMFLHAFVHWPHNPMERNPTMDLLTGVPNSMLHSPQVAPTLRRNQEHLYRFLGKHSAYFRRHRQ

SEQ ID NO: 140 - protein, 200 aa, WUHARV Adenovirus 1 contig00033_7
QNFIKIIDFGVRVLQRVFPLLHRQGPFVGIQGRSPGHGVGQGRGVHAADVVHVQGLPQHPDVSGVTAPPADAGSHVVVHLVRGSHEPVSQVGLVGFLGPVEDLPEDGVGVGRDGGALEDIKVGPGQSHGVLDELGVGFPELVHQGCGYQHVESAVVQRLADQVVGRLLFFLPQFAVEEVFLAVFPVLFGGKSFFVRSVRT

SEQ ID NO: 141 - protein, 173 aa, WUHARV Adenovirus 1 contig00033_11
HVKFVHGFVWTTAFFYRQGVRLSGLSERGVGEGEGVPHHHFQVLMFEVRVVAGALFPQREVGALFLPGIGEGECDVVKEDFPGAGHEVARDPEGSGHVRAVVDDLRRQDDLVEAVDVVAHDVKFDKARLSLEGRRFFQLLVGETVRRGETQLRPGPVGELRVSREERAPQVKG

SEQ ID NO: 142 - protein, 90 aa, WUHARV Adenovirus 1 contig00033_18
GQLAGLTNEGLLARDVHDQHEGYQLFPERAHPCVGFYVVGDKEPLGARVGADREEADLLPPVGGMGVDVVKVEVPPAHRAFVLMFVKRPQ

SEQ ID NO: 143 - protein, 74 aa, WUHARV Adenovirus 1 contig00033_21
CGESRSPAGAQSIRADVCKATAVVAALHALYLLNEMRFSPAHQKPEGEVETGAWWGGIPFALAVGVCVCALLIW

SEQ ID NO: 144 - protein, 105 aa, WUHARV Adenovirus 1 contig00033_22
PDKEGADADSHRQGEGDAAPPSPRLNFPLRFLVRGRKAHLIQEIQSVQRCDYCGRFTNISTNALCAGGTSTFTTSTPIPPTGGRRSASSRSAPTRAPSGSLSPTT

SEQ ID NO: 145 - protein, 564 aa, WUHARV Adenovirus 1 contig00033_34
GGRRRRLPPPRRRGCRPTKPPSQLPPPVSGARAKSASHSGDTERAALRLLRSLYKHQHECSVRRRDFYFHHINTHSSNWWQEISFFPIGSHARTQRLFVTYDVETYTWMGSFGKQLVPFMLVMHVSGEETLVRQACELALELRWDVWNDRPCTFYVVTPEKMAVGKKFREFRDRLQTLLALDLWSSFLAANPQLSDWARAELGLSSPDCLTYEELKKAPALKGQPRFIELYIVGHNINGFDEIVLAAQVINNRSDVPGPFRISRNFMPRAGKILFNDVTFALPNPRQKKRTDFTLWEQGACDDTDFKHQYLKVMVRDTFALTHTSLRKAAQAYALPVEKGCCPYKAVNEFYMLGSYRADEKGFPAEEYWKDREEYLLNRELWEKKQETAYNLVRETLDYCALDVLVTAALVDKLRESYAQFIQDSVGLSGANFNVFQRPTISSNSHAIFRQILYRAEKPHKTHLGDGLMAPSHEMYDYVRASIRGGRCYPTYIGVLREPLYVYDICGMYASALTHPMPWGPPLNPYERALAVKKWEDALQDTDTEIDYFNKILLPGIFTIDADP

SEQ ID NO: 146 - protein, 56 aa, WUHARV Adenovirus 1 contig00047_21
REWEDSQPRPLVPPHWRRQREDPDDSADDSSVLDLGGSGANPFAHLQPKGRSSRLY

SEQ ID NO: 147 - protein, 387 aa, WUHARV Adenovirus 1 contig00047_39
KRSGNLPEPWPQRVCFLPLFLPRRGRMRRAVRVTPAAYEGPPPSYESVMGSANVPATLEAPYVPPRYLGPTEGRNSIRYSELAPLYDTTKVYLVDNKSADIASLNYQNDHSNFLTTVVQNNDFTPTEAGTQTINFDERSRWGGQLKTILHTNMPNINEFMSTNKFRARLMVKKVENQPPEYEWFEFTIPEGNYSETMTIDLMNNAIVDNYLQVGRQNGVLESDIGVKFDTRNFRLGWDPVTKLVMPGVYTNEAFHPDIVLLPGCGVDFTQSRLSNLLGIRKRRPFQEGFQIMYEDLEGGNIPGLLDVPAYEDSVKKAEAQGREIRGDTFATEPHALVIKPLTEDSKKRSYNIITGTMDTEYRSWFLAYNYGDPEKGVRSWTILTTTD

SEQ ID NO: 148 - protein, 69 aa, WUHARV Adenovirus 1 contig00073_3
GRDVGQPGRGGVRGRGGDGKLGQPRRGGGRAFRGRGDRRKTTCIQRAFSEPTAEAPAPDAPGRLTQSQP

SEQ ID NO: 149 - protein, 150 aa, WUHARV Adenovirus 1 contig00073_5
EEMWDSQAEEVSEDEEEMESWDSLDEEEDELSEEEATEEKPPASSAPSLSRQPKPRPPTPPAGSLKASRRWDATGSPAAAAAGKAKRERRGYCSWRAHKSSIVNCLQHCGGNISFARRYLLFHHGVAFPRNVLYYYRHLYSPYETLGEKS

SEQ ID NO: 150 - protein, 92 aa, WUHARV Adenovirus 1 contig00073_9
GLLCREEKLRRRCRRQGSAGHRGAEKAHLSHSVAIFQQSRGQHPQRELKIKNRSFRSLTRSCLYHKREDQLQRTLDDAEALFSKYCSASLKD

SEQ ID NO: 151 - protein, 147 aa, WUHARV Adenovirus 1 contig00073_13
KTAPSAHSPAAVCTTREKTSCSAPWTTPKHCSANTAQRLLKTKRPALFPPRAPKTHVIASMSKEIPTPYMWSYQPQMGLAAGAAQDYSSKMNWLSAGPHMISRVNGIRAHRNQILLEQAAITATPRRQLNPPSWPAAQVYQETPRPT

SEQ ID NO: 152 - protein, 328 aa, WUHARV Adenovirus 1 contig00081_10
ASMALTTRNPEAFRQQPQANRFSAILEAVVPSRTNPTHEKVLTIVNALVDSKAIRRDEAGLIYNALLERVARYNSTNVQTNLDRLTTDVKEALAQKERFLRDSNLGSLVALNAFLSTQPANVPRGQEDYVSFISALRLLVSEVPQSEVYQSGPDYFFQTSRQGLQTVNLTQAFKNLQGMWGVKAPVGDRATISSLLTPNTRLLLLLIAPFTNSSTISRDSYLGHLITLYREAIGQAQIDEHTYQEITNVSRALGQEDTGSLEATLNFLLTNRRQKIPSQFTLSAEEERILRYVQQSVSLYLMREGATASTALDMTARNMEPSFYSAHR

SEQ ID NO: 153 - protein, 260 aa, WUHARV Adenovirus 1 contig00095_9
ARAPPTAVLVKNPGTEPLVTAWEKGMEVMTMLMEKFHVDNESRAAFKFLPDQGAVYRKICQTWLNEEHRGLPLTFTNQKTFTELMGRFLMAYMEAYAGVKRKSWEPTGCAVWEHRNTQQEGVLFCFHGVEMVCKEHVVEMDVTSENGQRALKEHPTKAKVVQNRWGRNVVQLKNEDARCCAEDINCGNNVFSSKSCGLFFTEGTKAQMAFRQMEEFLAASYPIMQRGQRRILIPLRCDCLNKPDLVPQIGRQMCKLTPLP

SEQ ID NO: 154 - protein, 265 aa, WUHARV Adenovirus 1 contig00102_23
PNMSKRKFKEELLQTLVPEIYGPPDVKPDIKPRDIKRVKKREKKEELAVVDDGGVEFIRSFAPRRRVQWKGRRVQRVLRPGTAVVFTPGERSAVRGFKRQYDEVYGDEDILEQAAQQIGEFAYGKRSRRGDLAIALDSGNPTPSLKPVTLQQVLPVSASTDSKRGIKREMEDLQPTIQLMVPKRQRLEEVLEKMKVDPSIEPDVKVRPIKEVAPGLGVQTVDIQIPVTSASTAVEAMETQTETPAAVGTKEVALQTDPWYEFATP

SEQ ID NO: 155 - protein, 62 aa, WUHARV Adenovirus 1 contig00124_18
HSETEPAYLISRHWRKCLRSSRVWVEMRSGRRTLCRKNRKRVRTCWWSWRGTTRVWPSSNAA

SEQ ID NO: 156 - protein, 253 aa, WUHARV Adenovirus 1 contig00124_22
SGASERQENEKEEEEGCYLLEGDVLLKHFARQSTILKEALQDRSEVPLDVAALSQAYEANLFSPRVPPKRQPNGTCEPNPRLNFYPVFAVPEALATYHIFFKNQRIPLSCRANRTAADRKLTLRNGASIPDITSLEEVPKIFEGLGRDEKRAANALQKEQKESQNVLVELEGDNARLAVLKRCIEVSHFAYPALNLPPKVMKSVMDQLLIKRAEPLDPDHPEAENSEDGKPVVSDEKLERWLETRDPQQLQER

SEQ ID NO: 157 - protein, 197 aa, WUHARV Adenovirus 1 contig00165_17
AARYLLTLYPLSYRECPSPTVEPLLPLPTGQLSGLPLRPHGRRKRRGFTGVPLPLQPVHPPQIAGLQHRAAQRNPGHRYLRDPGTPAARGCFRLEAHSGAVDLGLLTQICSRGLPRPQNSVLRRPISTTESPPHGLRHHPEQDPGPIAIHQPSAPRFPFEKGSGGVLRPPDRRGTQPVHTLRRSSPPETCRPREPPS

SEQ ID NO: 158 - protein, 191 aa, WUHARV Adenovirus 1 contig00165_18
LCTPSPTASVPPPLWSHCYLFQLANFLAYHSDLMEDVSGEGLLECHCRCNLCTPHRSLACNTELLSETQVIGTFEIQGPQQQEGASGLKLTPALWTSAYLRKFVAEDYHAHKIQFYEDQSRPPKAPLTACVITQSKILAQLQSINQARRDFLLKKGRGVYLDPQTGEELNPSTLSVEAAPPRHAAQGNRQA

SEQ ID NO: 159 - protein, 119 aa, WUHARV Adenovirus 1 contig00196_14
PSTQVSNFPVVGTELLPVHAKSFYNEQAVYSQLIRQSTALTHVFNRFPENQILVRPPAPTITTVSENVPALTDHGTLPLRSSISGVQRVTITDARRRTCPYVYKALGVVAPKVLSSRTF

SEQ ID NO: 160 - protein, 71 aa, WUHARV Adenovirus 1 contig00196_18
SHLLNMSILISPDNNTGWGLGSGKMYGGAKRRSSQHPVRVRGHFRAPWGAYKRGLSGRTAVDDTIDAVIAD

SEQ ID NO: 161 - protein, 55 aa, WUHARV Adenovirus 1 contig00257_5
VGHDPLGQHGLLDLREGGLEVVQVHEAVIGPRVDGVGAVGHNGPVDDLHAGLGDL

SEQ ID NO: 162 - protein, 129 aa, WUHARV Adenovirus 1 contig00257_9
GDHPTRHASRQLVRYGQLHLHHQHGGLSPLRGPGRLPDHPHADPTGRAGREGRGRPSVAATPAGLRLDSHGRQGRSRGSGGETDARLLQRPASLSERGLGHGRAPAHSTGRAQRRGPPRHHPPPEDRLL

SEQ ID NO: 163 - protein, 152 aa, WUHARV Adenovirus 1 contig00257_12
EITQPGMQVVNWSVMANCTYTINTGAYHRFVDLDDFQTTLTQIQQAVLAERVVADLALLQPLRGFGSTRMADRGEAEVPVERLMQDYYKDLRRCQSEAWGMAERLRIQQAGPKDVVLLATIRRLKTAYFNYIISSITSQLPADAPQRPTVLN

SEQ ID NO: 164 - protein, 129 aa, WUHARV Adenovirus 2 and 3 contig00003_11; identical to SEQ ID NO: 108

SEQ ID NO: 165 - protein, 132 aa, WUHARV Adenovirus 2 and 3 contig00003_15; identical to SEQ ID NO: 109

SEQ ID NO: 166 - protein, 134 aa, WUHARV Adenovirus 2 and 3 contig00003_21; identical to SEQ ID NO: 110

SEQ ID NO: 167 - protein, 125 aa, WUHARV Adenovirus 2 and 3 contig00003_25
IAWNNMPLPCLPPPPVCRDRSGCLSWLELALTTCLELYRDICRFEVCIAPEAERDLCGLQEWLHFALRRERERRRDRRYLETCWQRTWFCYYKYEEVRRSLVYDATRQTVSLQTGSLQSSPATTL

SEQ ID NO: 168 - protein, 158 aa, WUHARV Adenovirus 2 and 3 contig00003_29
GGSVSDAGTGVTWRRAGSGRGSATTSTRKCVGPWSTMQRDRRYRCRLAPYNRHQLPPCEDRGSAVVEENSRYLECENMNMHNVSEVRSIPSCISFIVLQEWPVYWDCILTAWEKHVMKMYMKVCICCATLDLDFHQTIRGYERWIIHCHCNSHRFSSV

SEQ ID NO: 169 - protein, 170 aa, WUHARV Adenovirus 2 and 3 contig00003_34
IWISIRPLGVMRDGLFTVIVTLTGSLQCRAGGAVLANWFKMAIYGSLINVRFPWYRQVVNRGLPREVLYAGSMFVRGRHLIYVKVRLDGHAVALLERMSFGWSVFSYGIMNNLIVMVCDSCRNLSEIQMRCCARRTRRLMIHAVRLLDNLTSYQPHRSRTERFRQRHCVV

SEQ ID NO: 170 - protein, 54 aa, WUHARV Adenovirus 2 and 3 contig00003_36
TDDPCCEAAGQSNFLPASQESHREVQTAPLRGLVEHHHTFTLSEFDRGDNPWRA

SEQ ID NO: 171 - protein, 70 aa, WUHARV Adenovirus 2 and 3 contig00003_39; identical to SEQ ID NO: 113

SEQ ID NO: 172 - protein, 33 aa, WUHARV Adenovirus 2 and 3 contig00003_43
HVLEGYSLKFTWRVVANEKFDIPCCSFSYITEQ

SEQ ID NO: 173 - protein, 39 aa, WUHARV Adenovirus 2 and 3 contig00006_29
PLQVETERGITTITLFCICPTPGLHEDLCCHLCAQFNKN

SEQ ID NO: 174 - protein, 205 aa, WUHARV Adenovirus 2 and 3 contig00006_36
LSRWKPNAGSLPSPCSASAPRPDYMKICVVIFALSLIKTELFAAPSTPRVVSTTKGSSIKGIKETVYFDNSTTLLTLNCSCSNELTQWFANGTICITFIYSTVLYQRNNSLCGNATLRSLTLTAPFSAVQYFCIGTGNGPSCYHRSFLKSVEPSPVFNISNSTLASKRFIYSPPVHRHPSPLLSLSVFILIILLNFILIEKLASL

SEQ ID NO: 175 - protein, 285 aa, WUHARV Adenovirus 2 and 3 contig00006_44
KTSFIMNSIVILFFLFTASYGNIANQVIDIYAQVGTNITLKLPNSTQHLPAVNSVLSINHMSWYKEEDFYSIFNQTLPYFFQGQLLCNFFNSEKTKWEHYPLQFDCTNESLTLFNVRQSYSGIYNAKVYTNFVERNTYFNLFVIDLPRPQCEISSYYVTEPPTQDSCIITINCASSKYPVFVHYNGKRSKRHYFLNERGGGGNLPNFYTTTFDFHNLKHSYNFTYPFNDLCNDIIALETGSDFSPIFIVIAVVSCIVIILGIAYLIYYCRTSKTKKSDAPEIRLL

SEQ ID NO: 176 - protein, 94 aa, WUHARV Adenovirus 2 and 3 contig00006_49
FFSRMVAAFFILLCIPIICTSTTFAAVSHLEPDCLPPFVVYLILTFVVCTAITSIACFFVTIFQAADYLYVRFAYFRHHPEYRNQNVASLLCLA

SEQ ID NO: 177 - protein, 81 aa, WUHARV Adenovirus 2 and 3 contig00006_53
TSPRVSESKRSFFTLSSMIRLFILHTLFTLAKCHCPFTKPWSFYTCYDVLPETPIAWLYVATAVLVFVATCIGVKLYFYLK

SEQ ID NO: 178 - protein, 269 aa, WUHARV Adenovirus 2 and 3 contig00007_10
YTLILRYSSPLILTDNNLTVGFSSPLRVIDNKLTFTFTSPLRYENETITFNYTEPLTLMNSNLALNVNSSKGLRVDGGSLGTNLSPDLRFNSSGAIAFGIQTLWTPPTSNPNCTVYTESDSLLSLCLTKCGAHVLGSVSLTGVAGTMTNMAETSLAIEFTFDDTGKLLHSPLVNTTFSIRQGDSPASNPTYNALAFMPNSTLYARGGSGEPRNNYYVQTYLRGNVQRPITLTVTFNSAATGYSLSFKWTAVVREKFAAPATSFCYITEQ

SEQ ID NO: 179 - protein, 293 aa, WUHARV Adenovirus 2 and 3 contig00007_22
NPVFPPFRFFQMKRARVDEDFNPVYPYDPPYAPIMPFITPPFTSSDGLQEKPLGVLSLKYKDPITTQNGSLTLKLGNGLNINNQGQLTSSAGEVDPPLTNADNKLALAYSDPLTLKNSRLTLSHNAPLAINNNSLSLEVSEPIFINNDNKLSLKADAPLTTSAGTLRLQSAAPLGLAEQTLKLLFSNPLYLRGDFLTLAIERPLAVTADGLLSLVLNPPLTTTNTGLALSTAVPLTVNNGNLSLNVKRPFIIQDGSLYMDFRPPLYLFNSEPQLGVNFNAPLTVRDNGLAINR

SEQ ID NO: 180 - protein, 85 aa, WUHARV Adenovirus 2 and 3 contig00008_3
FTAVVEFSTYRETYAKRPYNFSYPFNDLCNEIQALETGTDFTPIFIAAIVVSLITIIVSLAFYCFCKPKKPKFEKLKLKPVIQQV

SEQ ID NO: 181 - protein, 104 aa, WUHARV Adenovirus 2 and 3 contig00008_7; identical to SEQ ID NO: 120

SEQ ID NO: 182 - protein, 124 aa, WUHARV Adenovirus 2 and 3 contig00008_13; identical to SEQ ID NO: 121

SEQ ID NO: 183 - protein, 130 aa, WUHARV Adenovirus 2 and 3 contig00008_17; identical to SEQ ID NO: 122

SEQ ID NO: 184 - protein, 26 aa, WUHARV Adenovirus 2 and 3 contig00008_23
MKRTRVDEDFNPVYPYDTTTTPAVPF

SEQ ID NO: 185 - protein, 69 aa, WUHARV Adenovirus 2 and 3 contig00008_26; identical to SEQ ID NO: 114

SEQ ID NO: 186 - protein, 129 aa, WUHARV Adenovirus 2 and 3 contig00009_34
KYGFEQLKTHWLEPWEDMEMALDTFAKVALRPDKVYTIRRTVNIKKSVYVIGHGALVQVQTPDRVAFNCGMQSLGPGVIGLNGVTFQNVRFTGDDFNGSVFVTSTQLTLHGVYFLTLTIHVWSHGVGCL

SEQ ID NO: 187 - protein, 185 aa, WUHARV Adenovirus 2 and 3 contig00009_39
HPANPPRCLLFNFNNTCVESWGRVSLRGCSFHGCWKAVVGRIKSVMSVKKCIFERCVIALAVEGYGRIRNNAASENGCFLLLKGTASVKHNMICGSGLCPSQLLTCADGNCHTLRTVHIVSHSRRTWPTFEHNMLMRCAVHLGARRGVFMPYQCNFSHTKILLETDSFLEYVSMGCLTCQWNFLK

SEQ ID NO: 188 - protein, 73 aa, WUHARV Adenovirus 2 and 3 contig00009_41
FLPRVCFNGVFDMSMELFKVIRYDETKSRCRPCECGANHLRLYPVTLNVTEELRTDHHMQSCLRTDYESSDEE

SEQ ID NO: 189 - protein, 147 aa, WUHARV Adenovirus 2 and 3 contig00009_45
ERTTTCSLACVPTMNPVMRSEVRGGATKGIKGHEGWTRCFKMSGTTDGNAFEGGVFSPYLTSRLPSWAGVRQNVVGSTVDGRPVAPANSATLTYATVGSSLDTAAAAAASAAASTARGMAADFGLYNQLATAAVASRSLVQEDALNV

SEQ ID NO: 190 - protein, 94 aa, WUHARV Adenovirus 2 and 3 contig00010_26
QLNDEAVSSSTGLRPDGVFQLGGAGRSSFTTRQAYLTLQSSSSQPRSGGIGTLQFVEEFVPSVYFNPFSGSPGRYPDAFIPNFDAVSESVDGYD

SEQ ID NO: 191 - protein, 112 aa, WUHARV Adenovirus 2 and 3 contig00010_31; identical to SEQ ID NO: 117

SEQ ID NO: 192 - protein, 192 aa, WUHARV Adenovirus 2 and 3 contig00010_38
KPNAGSLPSPCSASAPRPDYMKTCVVIFALSLIKTELFAAPSTPSVISTTKSSSGKGTQTVFYSNSTSSIVLNCACTNELIQWIANGSVCKYFWGNEIVSRNNSLCKHCNSSTLILYPPFVTGWYMCVGSGLNPSCFHKWFLQKETLPNNSVSFFTLSYCCSPSGYSFKPLIGILALILIIFINFIIINNLQ

SEQ ID NO: 193 - protein, 67 aa, WUHARV Adenovirus 2 and 3 contig00010_40
QLTVNMLVILLLATFFALSHARTSIVGAGYNATLQSAYMPDSDQIPHITWYLQTSKPNSSFYEGNKP

SEQ ID NO: 194 - protein, 150 aa, WUHARV Adenovirus 2 and 3 contig00013_3
AFVSEWSQFLYAEDLGTPLEDRPLKSVYGDTDSLFVTEAGHRLMETQGKKRIKKMEATWFLIPLNPSSRGWWSARPSALSAEPTPTRPSRSSWPPNSTPSSVCTAPNVSTFPRESCAPRDTRPSPSATTSCFVAIWPTHRETTPASAPAG

SEQ ID NO: 195 - protein, 166 aa, WUHARV Adenovirus 2 and 3 contig00013_5
ETHQKNGGNLVFDPAKPELTWLVECETVCAQCGADAYSPESVFLAPKLYALKCLHCTKCQHVSKGKLRAKGHAAESLSYDLMLRCYLADSQGDDARFSTSRMSLKRTLASAQPGAHPFTVTETTLTRTLRPWKDRTLAALDAHRLVPYSESRPNPRNQEVCWIEIP

SEQ ID NO: 196 - protein, 317 aa, WUHARV Adenovirus 2 and 3 contig00013_15
TRAHVAGGVRDRLRSVRSRRLLARVGLPGPQTLRPQVSALHQMSARFQGKAARQGTRGRVPQLRPHASLLSGRLTGRRRPLQHQQDEPEAHPRKRPARGSSLHRHRDHPHPNAETLEGQNPRGPGRPPAGALQRKSAQPPQPRSLLDRDSIEHVTELWDRLYLLRQSLEKMPMADGLKPLKHFNSLEELLSLGGERLLQNLVSENKHVRSMMNDVAPLLRPDGSCSSLNYQLQPVIGVIYGPTGCGKSQLLRNLLSTQLINPPPETVFFIAPQVDMIPPSEIKAWEMQICEGNYAPGPDGTIIPQSGTLLPRFVKMA

SEQ ID NO: 197 - protein, 79 aa, WUHARV Adenovirus 2 and 3 contig00013_27; identical to SEQ ID NO: 130

SEQ ID NO: 198 - protein, 110 aa, WUHARV Adenovirus 2 and 3 contig00013_32
VGQIATKHEVVAEGLGRVSLGAQLSLGNVLTFGAVQTLEGVEFGGQEDRLGRVGVGSALSADGLALHQPRELGFSGIKNQVASIFLMRFLPCVSMSLCPASVTKRLSVSP

SEQ ID NO: 199 - protein, 65 aa, WUHARV Adenovirus 2 and 3 contig00013_34
RDQKPSCLHFFDAFLTLRLHESVSRFRDKKAVGVPVDRLEGAIFQRCSEVFRVQELGPLRDKGLK

SEQ ID NO: 200 - protein, 72 aa, WUHARV Adenovirus 2 and 3 contig00017_22
PLKLINNSLAIDINSSKGLSSVGGSLAVNLSSDLKFDSNGSIAFGIKPCGPLRPRLATAPSTARAIPYLVSV

SEQ ID NO: 201 - protein, 178 aa, WUHARV Adenovirus 2 and 3 contig00017_26
QQRIHSFWHQTLWTAPTSTGNCTVYSEGDSLLSLCLTKCGAHVLGSVSLTGLTGTITQMTDISVTIQFTFDNNGKLLSSPLINNAFSIRQNDSTASNPTYNALAFMPNSTIYARGGGGEPRNNYYVQTYLRGNVQKPIILTVTYNSAATGYSLSFKWTALAREKFATPTTSFCYITEQ

SEQ ID NO: 202 - protein, 158 aa, WUHARV Adenovirus 2 and 3 contig00017_32
KVCNPNNFVLLHYRTIKPCTPPFRFFQMKRARVDEDFNPVYPYDPPHAPVMPFITPPFTSSDGLQEKPLGVLSLNYRDPITTQNGSLTVKLGNGLTLDNQGQLTSTAGEVEPPLTNANNKLALVYSDPLAVKRNSLTLSHTAPLVIADNSLALQVSEP

SEQ ID NO: 203 - protein, 173 aa, WUHARV Adenovirus 2 and 3 contig00018_31
SFLLRAAAMRLVPEMYGVFCSETVRNSDELLNTDLLDVPNSPVASPPSLHDLFDVEVDPPQDPNEDAVNSMFPECLFEAAEEGSHSSEESKRGEELDLKCYEECLPSSDSETEQTGGDCCTEPVVKNELVLDCPDQPGHGCRACAFHRNASGNPETLCALCYLRLTSDFVYSK

SEQ ID NO: 204 - protein, 45 aa, WUHARV Adenovirus 2 and 3 contig00018_33
CFTGDVSDTEGDGDRSGSANSPCTLGAVVPVGIIKPVAVRVSGRR

SEQ ID NO: 205 - protein, 83 aa, WUHARV Adenovirus 2 and 3 contig00024_15
LLPGCGVDFTQSRLSNLLGIRKRRPFQEGFQIMYEDLEGGNIPALLDVSKYEASIQRAKAEGREIRGRHLCGSSPGPGNSAFN

SEQ ID NO: 206 - protein, 252 aa, WUHARV Adenovirus 2 and 3 contig00024_20
ELESAAHSKRAFKSCMRTWREVIYPPYWTCRSTKLAYNAPKRRVERFGGDTFAVAPQDLEIVPLTKDSKDRSYNIINNTTDTLYRSWFLAYNYGDPEKGVRSWTILTTTDVTCGSQQVYWSLPDMMQDPVTFRPSTQVSNFPVVGTELLPVHAKSFYNEQAVYSQLIRQSTALTHVFNRFPENQILVRPPAPTITTVSENVPALTDHGTLPLRSSISGVQRVTITDARRRTCPYVYKALGVVAPKVLSSRTF

SEQ ID NO: 207 - protein, 68 aa, WUHARV Adenovirus 2 and 3 contig00024_22
PSPTPDVEPAPTFTKRLAWWLLKFFLVAPSKNMSILISPDNNTACWGLGSGKMYGGAKRRSSQHPVRC

SEQ ID NO: 208 - protein, 53 aa, WUHARV Adenovirus 2 and 3 contig00025_2
EDSQPRPLVPPHWRRQREDPDDSADDSSVLDLGGSGANPFAHLQPKGRSSRLY

SEQ ID NO: 209 - protein, 236 aa, WUHARV Adenovirus 2 and 3 contig00025_14
KRSGNLPEPWPQRVCFLPLFLPRRGRMRRAVRVTPAAYEGPPPSYESVMGSANVPATLEAPYVPPRYLGPTEGRNSIRYSELAPLYDTTKVYLVDNKSADIASLNYQNDHSNFLTTVVQNNDFTPTEAGTQTINFDERSRWGGQLKTILHTNMPNINEFMSTNKFRAKLMVEKSNAETRQPRYEWFEFTIPEGNYSETMTIDLMNNAIVDNYLQVGRQNGVLESDIGVKFDTRNFR

SEQ ID NO: 210 - protein, 123 aa, WUHARV Adenovirus 2 and 3 contig00027_3
GVRVLQRVFPLLHRQGPFVGIQGRSPGHGVGQGRGVHAADVVHEQGLPQHPDVSGVTAPPADAGSHVVVHLVRGSHEPVSQVGLVGFLGPVEDLPEDGVGVGRDGGALEDIKVGPRAVPRSLG

SEQ ID NO: 211 - protein, 66 aa, WUHARV Adenovirus 2 and 3 contig00027_9
AAFSKRGVGEGRRCPDHHFQVLMFEVRVVAGALFPQREVGALFLPGIGEGECDVVKEDFPGAGHEV

SEQ ID NO: 212 - protein, 39 aa, WUHARV Adenovirus 2 and 3 contig00027_13
WSGHLRPSPTPLLEKAAQAYALPVEKGCCPYKAVNEFTC

SEQ ID NO: 213 - protein, 140 aa, WUHARV Adenovirus 2 and 3 contig00027_14
NFMPRAGKILFNDVTFALPNPRQKKRTDFTLWEQGACDDTDFKHQYLKVMVGTPSPFTHTSLRKGRSSVRPAGRKRLLSIQSRERIYMLGLPSGRKRISRRRVLERPRGYLLNRELWEKNKRRPTTWSARRWTTALSTCW

SEQ ID NO: 214 - protein, 84 aa, WUHARV Adenovirus 2 and 3 contig00027_15
TNLHVRSTERTKKDFPPKSTGKTARIPPQPRTVGEKQETAYNLVRETLDYCALDVLVTAALVDKLRESYAQFIQDSVGLPGGQL

SEQ ID NO: 215 - protein, 138 aa, WUHARV Adenovirus 2 and 3 contig00027_18
PQPWWTSSGNPTPSSSKTPWDCPGANFNVFQRPTISSNSHAIFRQILYRAEKPHKTHLGDGLMAPSHEMYDYVRASIRGGRCYPTYIGVLREPLFVYDICGMYASALTHPMPWGPPLNPYERALAVKKWEDALQDTDA

SEQ ID NO: 216 - protein, 27 aa, WUHARV Adenovirus 2 and 3 contig00032_17
AVEKLEDLLQEEQTEPLDLSMKRPKLT

SEQ ID NO: 217 - protein, 162 aa, WUHARV Adenovirus 2 and 3 contig00032_20
EHSCLNGSLRNLREFDVVRRLLELASDKTSRLWRFWFGSTLSNVLYRVKKEQETQFARLLADTPGVFVALDLGHHSLFQEKIIKNLTFSSPGRTVASAAFITYILDQWSNSGSHLSWEYMLDYMSMALWRAMLRRRVCIYLRAQPPRLDRVEEEDEPGRPRT

SEQ ID NO: 218 - protein, 115 aa, WUHARV Adenovirus 2 and 3 contig00032_21
AVGRYSWSFCGSGSRPSLSFSRKNHQKLNFFVSWSHGCFRCLYYLYFGSMEQQRQSPVVGVHAGLHVDGAVEGHAAEEGLHLLAGAASAAGPSGGGGRAGETENLRAGLDPPTED

SEQ ID NO: 219 - protein, 113 aa, WUHARV Adenovirus 2 and 3 contig00032_22
LFRLLVARLLPLPLLPIFWINGATAAVTCRGSTCWITCRWRCGGPCCGGGFAFTCGRSLRGWTEWRRRTSRGDREPEGRAGPSNGGLGAEDDPEEGTSGARKKQKTESEPRNY

SEQ ID NO: 220 - protein, 260 aa, WUHARV Adenovirus 2 and 3 contig00033_24
NTNSENLLGQQAAPNRANYIAFRDNFIGLMYYNSTGNMGVLAGQASQLNAVVDLQDRNTELSYQLMLDAIGDRSRYFSMWNQAVDSYDPDVRIIENHGVEDELPNYCFPLNAQGIANTYKGVKKNNGNWAKDDAVVETNEIGIGNVFAMEINLTANLWRNFLYSNIALYLPDSYKYSPGNITLPENKNSYNYINGRVTAPGLVDTFVNIGARWSPDPMDNVNPFNHHRNAGLRYRSMLLGNGRYVPFHIQVPQKFFAIKN

SEQ ID NO: 221 - protein, 213 aa, WUHARV Adenovirus 2 and 3 contig00046_8
LLCYRQRRVTVAASAAFKMATPSMMPQWSYMHIAGQDASEYLSPGLVQFARATDTYFSLGNKFRNPTVAPTHDVTTDRSQRLTLRFVPVDREDTAYSYKVRYTLAVGDNRVLDMASTYFDIRGVLDRGPSFKPYTGTAYNALAPKGAPNACQWTTTNGGNKTNTFAQAPLIGTAIDGTNGLQIGQDNGQAVYADKTFQPEPQVGESQWNTNPT

SEQ ID NO: 222 - protein, 69 aa, WUHARV Adenovirus 2 and 3 contig00053_3
TGLKSSSTRVLFIYEKMKIVGKDKEVDINICFRVWRKFAAHHHVPYESWEEGKVVLLNDVTKKLLSNLR

SEQ ID NO: 223 - protein, 111 aa, WUHARV Adenovirus 2 and 3 contig00053_13
ERIAAQRQRETRVLEYFELQQLKESHWCEKGVLCHVKQAALSYDVSLQGHELSYTLPSQKQTFCTMMGSTSITITQQTGPVEGAILCHCHAPDCMPKLIRTLCALGDIFKM

SEQ ID NO: 224 - protein, 26 aa, WUHARV Adenovirus 2 and 3 contig00053_19
MKRTRVDEDFNPVYPYDTTTTPAVPF

SEQ ID NO: 225 - protein, 193 aa, WUHARV Adenovirus 2 and 3 contig00058_9
MELSIPQSGTLLPRFVKMAYDELTLEQNYDVSNPQNVFAKAAARGPIAIIMDECMENLGGHKGVSKFFHAFPSKLHDKFPKCTGYTVLVVLHNMNPRRDLGGNIANLKIQAKMHIISPRMHPSQLNRFVNTYTKGLPLAISLLLKDIFQFHAQKPCYDWVIYNTTPEHDALQWSYLHPKDGLMPMYLNIQAAL

SEQ ID NO: 226 - protein, 193 aa, WUHARV Adenovirus 2 and 3 contig00059_6
LQYENGAAAVKLSTAPPLQYTTQLQLNLGAGLRLGPTRNLDVAINPNKGLTWENNEVVTKLGQGLYFDSSGSIALSPTNPRPDTLWTTADPSPNCTVYESLDSRLWLALVKCGGMVHGSIALQAEKGQLLRPTASFISIVIYFYSDGVRRTNYPTIGNDEGTLANSATWGYRQGQSADTNVTNAVEFMPSLHL

SEQ ID NO: 227 - protein, 177 aa, WUHARV Adenovirus 2 and 3 contig00062_7
GLAARKELHRSRASRVCKRSRNSRNFFPRPFSPASPRRKCRGRSFQTSHRSSRASSQAWNEGLLARDVHDQHEGYQLFPERAHPCVGFYVVGDKEPLGARVGADREEADLLPPVGGMGVDVVKVEVPPAHRAFVLMFVKATAVVAALHALYLLNEMRFSPAHQKPEGEVETGAWYIV

SEQ ID NO: 228 - protein, 142 aa, WUHARV Adenovirus 2 and 3 contig00062_10
HDIPSPSLNFPLRFLVRGRKAHLIQEIQSVQRCDYCGRFYKHQHECSVRRRDFYFHHINTHSSNWWQEISFFPIGSHARAQRLFVTYDVETYTWMGSFGKQLVPFMLVMHVSGEETLVPSLRAGPRAPMGRLERPPPALSTW

SEQ ID NO: 229 - protein, 97 aa, WUHARV Adenovirus 2 and 3 contig00062_14
KPTHGWARSGNSWYPSCWSCTSRARRPSFQACELALELRWDVWNDRPLHFLRGDAGENGRGKKFREFRDRLQTLLALDLWSSFLAANPQLSDWARAE

SEQ ID NO: 230 - protein, 170 aa, WUHARV Adenovirus 2 and 3 contig00078_6
KGTFYLNHTFKKVSIMFDSSVSWPGNDRLLTPNEFEIKRSVDGEGYNVAQSNMTKDWFLIQMLSHYNIGYQGFYVPENYKDRMYSFFRNFQPMSRQVVDTVTYTDYKDVKLPYQHNNSGFVGYMGPTMREGQAYPANYPYPLIGETAVPSLTQKKFLCDRVMWRIPFSGN

SEQ ID NO: 231 - protein, 164 aa, WUHARV Adenovirus 2 and 3 contig00082_6
EERILRYVQQSVSLYLMREGATASTALDMTARNMEPSFYSAHRPFINRLMDYFHRAAAMNGEYFTNAILNPHWMPPSGFYTGEFDLPEADDGFLWDDVSDSIFTPANRRFQKKEGGDELPLSSVEAASRGESPFPSLSSASSGRVTRPRLPGESDYLNDPLLEN

SEQ ID NO: 232 - protein, 35 aa, WUHARV Adenovirus 2 and 3 contig00098_11
GVEVDLKCYEECLPSSDSETEQTGGDGCAEPVVKK

SEQ ID NO: 233 - protein, 48 aa, WUHARV Adenovirus 2 and 3 contig00098_13
KNELVLDCPDNPGHGCRACDFHRNASGNPETLCALCYLRLTSHCVYSK

SEQ ID NO: 234 - protein, 45 aa, WUHARV Adenovirus 2 and 3 contig00098_16
CFTGDVSDAEGDGDRSGSANSPCTLGAVVPDGIIKPVAVRVSGRR

SEQ ID NO: 235 - protein, 141 aa, WUHARV Adenovirus 2 and 3 contig00110_13
TTDRSQRLTLRFVPVDREDTAYSYKVRYTLAVGDNRVLDMASTYFDIRGVLDRGPSFKPYSGTAYNSLAPKGAPNPSEWTDTSDNKLKAYAQAPYQSQGLTKDGIQVGLVVTESGQTPQYANKVYQPEPQIGENQWNLEQE

SEQ ID NO: 236 - protein, 133 aa, WUHARV Adenovirus 2 and 3 contig00126_5
TRLGQSVLHCTLQGEARRDYVRDCIYLFLTLTWQTAMGVWQQCLEERNLKELDKLLCRQRRALWSGFSERTVASALADIIFPERLMKTLQNGLPDFISQSILQNFRSFVLERSGILPAMSCALPSDFVPLSYR

SEQ ID NO: 237 - protein, 72 aa, WUHARV Adenovirus 2 and 3 contig00126_9
LMKSGRPFCKVFIRRSGKMMSARALATVRSLKPDHRARRWRQRSLSSSLRFLSSKHCCQTPMAVCQVRVRKR

SEQ ID NO: 238 - protein, 50 aa, WUHARV Adenovirus 2 and 3 contig00136_2
SLGMTGSGRRRALRRRMKGGILPALIPIIAAAIGAIPGVASVALQAARNK

SEQ ID NO: 239 - protein, 79 aa, WUHARV Adenovirus 2 and 3 contig00136_6
INKGFCTYDLALTILCRKSMEDINFTSLAPRHGSRPLMGTWNDIGTSQLNGGAFNWGSLWSGIKNFGSTIKSYGSKAWL

SEQ ID NO: 240 - protein, 63 aa, WUHARV Adenovirus 2 and 3 contig00172_4
NIENHGVEDELPNYCFPLGGMVVTDNYNSVTPQNGGSGNTWQADNTTFSQRGAQIGSGNMFAL

SEQ ID NO: 241 - protein, 73 aa, WUHARV Adenovirus 2 and 3 contig00172_7
RLKMEAVEIHGRQTILHLVKEERRLAPETCLPCEINLQANLWRGFLYSNIGLYLPDSLKITPDNITLPENKNT

SEQ ID NO: 242 - protein, 73 aa, WUHARV Adenovirus 2 and 3 contig00175_8
RSGGSGPNCDFKISAPDVMGALQLVRQFWKQNLEEVPLPRLVLPEFRWSTRLQYRNVSLPTGHDDPSPEPFDF

SEQ ID NO: 243 - protein, 102 aa, WUHARV Adenovirus 2 and 3 contig00178_8
AWYLDVFQGIFDTTIPSYFTGVKLCESSPLQEQEWFHPPLQFHCINNSLHLYNLKPSDAGVYNAKVFSDSIEHNTYFQLHVISFPKPNCNINSTYLTNDYYL

SEQ ID NO: 244 - protein, 101 aa, WUHARV Adenovirus 2 and 3 contig00181_9
KHFNDNGVRINYPTLDNQGTLGRDSTWGYRQGQSANTNVTNAVEFMPNSSRYPRGRGEQAQNQTVGYTCLQGNLSMPIFFQVQYNYVTTGYSFKFTWHRRD

SEQ ID NO: 245 - protein, 85 aa, WUHARV Adenovirus 2 and 3 contig00217_9
SNRGIKREMEDLHPTIQLMVPKRQRLKEVLEKMKVDPSIEPDVKVRPIKEVAPGLGVQTVDIQIPVTTASTAVEAMETQTETPGL

SEQ ID NO: 246 - protein, 78 aa, WUHARV Adenovirus 2 and 3 contig00224_5
ISPPFVNSDGLQENPPGVLSLRIAKPLYFDMERKLALSLGRGLTITANGQLESTQSVQTNPPLTVTNNNTLILRYSSP

SEQ ID NO: 247 - protein, 80 aa, WUHARV Adenovirus 2 and 3 contig00227_7
KDQGLVKCHCPFTKPWSFYTCYDVLPETPIAWLYVATAVLVFVATCIGVKLYFYLKIGWLHPPEDLPRYPLVNNFQQPLP

SEQ ID NO: 248 - protein, 72 aa, WUHARV Adenovirus 2 and 3 contig00259_5
FVNSDGLQENPPGVLSLRIAKPLYFDMERKLALSLGRGLTITAAGQLESTQSVQTNPPLIITNNNTLTLRHS

SEQ ID NO: 249 - protein, 68 aa, WUHARV Adenovirus 2 and 3 contig00273_2
DVVEKFHVDNESRGAFKFLPDQGAVYRKICQTWLNEEHRGLPLTFTNQKTFTELMGRFLMAYMEAYTG

SEQ ID NO: 250 - protein, 56 aa, WUHARV Adenovirus 2 and 3 contig00295_8
IPCYDWVIYNTTPEHDALQWSYLHPRDGLMPMYLNIQAHLYRVLENIHKVLNDRDR

SEQ ID NO: 251 - protein, 45 aa, WUHARV Adenovirus 2 and 3 contig00300_2
GWLHPPEDLPRYPLVNNFQQPLPPPDPLPRAPSVVSYFQLTGGDD

SEQ ID NO: 252 - protein, 52 aa, WUHARV Adenovirus 2 and 3 contig00306_3
PTFFPMAHNTASTLEAMLRNDTNDQSFNDYLCAANMLYPIPANATSVPISGP

SEQ ID NO: 253 - protein, 48 aa, WUHARV Adenovirus 2 and 3 contig00311_4
SCPFTKPWSFYTCYNVLPETPIAWLYVATAVLVFAATCIGVKLYFYLK

SEQ ID NO: 254 - protein, 48 aa, WUHARV Adenovirus 2 and 3 contig00313_1
THTMNLLTGVPNSMLHSPQVTPTLRRNQDQLYTFLEKHSAYFRRHRQR

SEQ ID NO: 255 - protein, 39 aa, WUHARV Adenovirus 2 and 3 contig00323_3
WSRSMERNPTMNLLTGVPNSMLHSPQVVPTLHRNQQHAE

SEQ ID NO: 256 - protein, 33 aa, WUHARV Adenovirus 2 and 3 contig00328_1
PPLNLTDNSLVLGYSSPLRVTDNKLTFNFTSPL

SEQ ID NO: 257 - protein, 255 aa, WUHARV Adenovirus 4 GZXIHWF02JYIJE
GATGTGGAGGAGGGAGATAAGTCAGTCCATACTAGTTCTCCTTGCACTTTGGGGGCTGTGGTTCCAGATAATGTTATTAAACCCGTGGCGGTCAGAGTATCAGGCAGGCGGTGTGCAGTCGAAAAAATTGAAGACTTGCTGCAGGAAGAGCAGATGCAACCTTTGGACCTGTCCCTCAAACGCCCTAAGATGACCTAAGCCTGTTTATTGAGTGCAATAAAACTGTTGATCTTTGAACTGTGTTATGTGTTGGGT

SEQ ID NO: 258 - protein, 533 aa, WUHARV Adenovirus 4 GZXIHWF01BXOFZ
TAGCCGCCTCGAACAGACATTCGGGAAACATACTATTTACCGCGTCCTCGTTGGGATCTGCCGGAGGATCCACTTCCACATCGAAAAGGTCGTGAAGTGACGGAGGCGAAGCCACAGGCGAATTGGGAATTTCCAGCAAATCTGAATTCAGCAGGTCATCTGAGTTCCGCGCCGCCTCGTCGCAAAAAAACACCAAACATCTCGGGGACCAGCCTCATTGTGGCAGCGCGGAGGAGAAAACTCTACTCGCCAGCACTCAAGAGTGGCCTCTTGATGATCTGACAGCGTTTAAATACCCGGCGAAAACGCTGAGGAGTACAATAAATGGGACCTTTGAGCCTTCTCGTGGTACTGCCACGTAGCGAAACCTCCCCGTCAGCGCCCAAAGTTCACTGCTGAACAGCAGAAATTCCGCCCAGTCATAAAAAGTACATATTAACCTCAACTTCCTCATTACCCAGTTTTCGCGCCAAATTACACAAAACTTACAAGTATACGCCCAAATTACCCATCTTCCGGTATAAAACCTCCTT

SEQ ID NO: 259 - protein, 49 aa, WUHARV Adenovirus 5 contig00001_6
IRSRYALHYSTFYPSDGLQEKPLGVLSLNYKDPITTQNGSLTLKIGNGL

SEQ ID NO: 260 - protein, 117 aa, WUHARV Adenovirus 5 contig00002_4
AASNCTVFTNGDSLLCLCLTKCGAHVLGSVSLTGMQGTITAMTQNYISIQFLFDNNGALTSSPLLNNNTWGIRQNDTSSANPAYNALAFMPNSTVYVRGQSGEPRNNYYTQTYLRET

SEQ ID NO: 261 - protein, 76 aa, WUHARV Adenovirus 5 contig00002_8
EVKVVSPEITITPKHTLGKLKKPIILTVTYNSAASGYSLTFKWDAVVTEKFATPTSSFCILQNNKFLLYHQFVFFR

SEQ ID NO: 262 - protein, 95 aa, WUHARV Adenovirus 5 contig00003_2
RTISSKKQPLTLSHTAPLVVANDSLALQVSEPIFINDDDKLALQTAAPLVTNAGTLRLQSAAPLGLVENTLRLLFSKPLYLQNDFLALGIERPWL

SEQ ID NO: 263 - protein, 40 aa, WUHARV Adenovirus 5 contig00003_4
TPLAIAAAGTLALQLTPPLKTNDDGLTLSTVEPLTVKTET

SEQ ID NO: 264 - protein, 54 aa, WUHARV Adenovirus 5 contig00003_7
RADTIHSRAINCKNGNLGLQISRPLVVQNSSLSLAITPPLRLFNSDPVLGLGFT

SEQ ID NO: 265 - protein, 32 aa, WUHARV Adenovirus 5 contig00004_1
SALEGYSLKFTWRVVANQAFDIPCCSFSYITE

SEQ ID NO: 266 - protein, 70 aa, WUHARV Adenovirus 5 contig00005_6
PHPLLRSPLYPPFVNSDGLQENPPGVLSLRIAKPLYFDMERKLSASLGRGLAITSTGQLESTQNVQTTPP

SEQ ID NO: 267 - protein, 59 aa, WUHARV Adenovirus 5 contig00006_2
LFIYEKMKIVGKDKEVDINICFRVWRKFAAHHHVPYESWEEGKVVLLNDVTKKLLSNLR

SEQ ID NO: 268 - protein, 93 aa, WUHARV Adenovirus 5 contig00007_6
FFQNGSCFLHFLCIPIICASTTFAAVSHLEPDCLPPFVVYLILTFVVCTAITSIACFFVTIFQAADYLYVRFAYFRHHPEYRNQNVASLLCLA

SEQ ID NO: 269 - protein, 67 aa, WUHARV Adenovirus 5 contig00007_9
TSPRVSESKRSFFTLSSMIRLFILHTLFTLAKCHCPFTKPWSFYTCYDVLPETPIAWLYVATAVLVL

SEQ ID NO: 270 - protein, 141 aa, WUHARV Adenovirus 5 contig00007_14
TVLLLKNWMASSPEDLPRYPLLITFNSLCRLLILFRELPPLLATFNSPVEMTDSQDIDISVERIAAQRQRETRVLEYFELQQLKESHWCEKGVLCHVKQAALSYDVSLQGHELSYTLPSQKQTFCTMMGSTSITITQQTGP

SEQ ID NO: 271 - protein, 128 aa, WUHARV Adenovirus 5 contig00009_11
CCRCLRSPISCSHDGVSTHGYRGRPFGAFNMHGMNLQTICRNIIREWRNENYLGIVQSCSLMIEEFDNNAFALLVFVEVRVQALLEAAIDSLENRIMFDLAVKFHQGSGGDRCHLRDLHFDPLVNRLE

SEQ ID NO: 272 - protein, 149 aa, WUHARV Adenovirus 5 contig00010_16
HPSGYAVFATTAANTTPKAVLYAEDVNLEGPDTHLVFKPTVTEGTTSAEALLAQQAAPNRPNYIAFRDNFIGLMYYNSTGNMGVLAGQASQLNAVVDLQDRNTELSYQLMLDALGDRSRYFSMWNQAVDSYDPDVRIVENHGVEDELPN

SEQ ID NO: 273 - protein, 82 aa, WUHARV Adenovirus 5 contig00011_2
FVVCILPEAERDLCGLQEWLHFALRTERARRRDRRYVDTCWQRTWFCYHKYQEVRRSLVYDAARQTVSLQTGSLRSSPATTL

SEQ ID NO: 274 - protein, 99 aa, WUHARV Adenovirus 5 contig00011_4
EQSARDAGTGVTWIPVGSGRGSATTSTRRCVGLWSTMQRDRRYRCRLAPYDRHQLPPCEDRSSAVVEENSRYLECENMNMHNVSEVRSIPSCISFIVLQ

SEQ ID NO: 275 - protein, 88 aa, WUHARV Adenovirus 5 contig00012_8
YMKICVVIFALSLIKTELFAAPSTPRVVSPKVVDSSSVRGIRETVYFYNSTTLLTLNCSCTNELIQWFANGSLCQVFFNSAVLPEFGS

SEQ ID NO: 276 - protein, 38 aa, WUHARV Adenovirus 5 contig00013_10
DGAMADEHIYVHLLGRRAFLPQQQGYSNMYVLFHRRIL

SEQ ID NO: 277 - protein, 40 aa, WUHARV Adenovirus 5 contig00013_11
YVCAFSPEDFVIAPRGIVLLSLQLSLDIPAGYLGRFFSVA

SEQ ID NO: 278 - protein, 58 aa, WUHARV Bocavirus 1 GZXIHWF02HMA4O_3
HDRRGELHAQSIDPLRFFANYLLPKNKNISSYTTPEICTPTDNWVILVEKTYAHTLIP

SEQ ID NO: 279 - protein, 975 aa, WUHARV Calicivirus 2 contig00010_30
TSTIMILTTNLEDISSGNARMATLRRVDFHYHVSSFAVEHWQKGGCNGPKPYKDDFSHLTIRQLPKFATNFHGNTLFGQWNPQPVSPNTVKANTLAVWKMQSDEYPEKPVGWLMLQLGCSYFAGLRHVNDLRRGVIPRIAYTGGDIKCTVMGYKLDLYSLDGYLTGTVEKGDVKVSNEIFYDCETGHEVKVDSTPYDIRLNEWKMGVSLHWLLTKLLNFFLKANAVQDSNDTAQALGVFEAKGKSKKGRGARKLKAKVSRRYKFSPQEYNEFLKRREDAAQRGIVYTVDDYLDDIGYNSDEEDEEWWDPDGEFKQKHDISYEPSDDYYDEGYVCAFVFPATSGGVKKGCATQISGSKFLTATHVAKTCDKIRGLPFKIIKMDGELCLVDVPGVKSQTKLEISFPAIGDVVNLCPSRGSQRPNIPVVVRSIGNTNIAGKFLNVFTGTVVAAGKKSDGLGSEPGDCGSPYLKFVNGKPTLVGIHTAGSYTTNQVAGLVIPSKFNLEGKTTYVPNKTPPETTQIWYTKYSEEVNVEMHPPLVGTKDPRNPMPTSEILNEMFKPYTIPNPGRVNQADLLAAAEAVRVKLSALVKTRMDLSAEEAFETLDPSTSSGYPLYCKKDKSLPGVESTIKRVQNWLDGKGQLHRPIYTAALKDEPVKQSKIDEGKKRLLWCAPLETSIACAALMTDICAQLKIMRGEWPGKVGMNPTVEWWFLDQQFGPNVLCVDYSRWDSTMIQSIYEIGVKTLFGLSKHPKASELIDLLCQPRKVIVNDEIRTVYQGLPSGIPTTSLLNCVCHWIASTIAIAYAAKIPIAEAVNWPLAVYGDDEVINCPCSNFAVRYANEMRRMGFHPTNPDKSEFFHPIHKSKMEFLSRTTQYVGGRCVGALKKTSIERQLYLTRGPQHSDPLEIGFPGPWFGEQLMCVMGEASLHGEQYFNEIKDKCARAAHLAHVKFEPWPFWPTFLWATQNDIGCSEFL

SEQ ID NO: 280 - protein, 421 aa, WUHARV Calicivirus 2 contig00010_46
LVTIILDMESNKTEQVTGATGISQSTVSAPLPEAVSSLSLAPTVNTLDPWIYLNHTEVPGGTFTVASATQPGTILLELEISPELNLYTSHLFRMYAGWSGGFSLKLLVAGNAFSAGKLIAAIIPPNIEVPNSAYLLTGFPHEILDFRTADSMEIIAPDIKNIDYHFRGDKLGKLVVMVYSPLRSTATDFEIEIKLTSAPLPDFKFTMLVPPIQNNAMPIWSIPQAPPYSMVNPRSPLTPVVELYINSSYTTCNHQLGRYTISQGAIGTSTFNPAGAWTATYTAEAGSVIDHPEWRCALLDLPDNPTLDPTLPPVPRGFCDWGSGIRSGDQQHLVCFTGKKVEGGFQNVDAHMWDYGDNATVGLDNTYQRSIYISDTTLEKDSQYLIIPMGVSGRANDDTVQVAPNCYGSWDYAPVVAPPTW

SEQ ID NO: 281 - protein, 78 aa, WUHARV Calicivirus 2 contig00010_49
PPPLGEQFVWFRSQLPASKTTTSSGVNSVPVNVNALMSPDLIRSAYASGFPLVKLHFLTMFFLVVVLSGSSNCILRGT

SEQ ID NO: 282 - protein, 85 aa, WUHARV Calicivirus 2 contig00010_51
PHTQCLCLWFPLGKVALLDYVLFGGSVVRQFKLYPEGYMTANTTGSNTGFVIPPDGYFRFNSWVSPSFVISSVVDLNVQTAVVFR

SEQ ID NO: 283 - protein, 176 aa, WUHARV Calicivirus 2 contig00010_59
IMAGAAFASGLGQASGGILGSLISGAVQAGLNEQQFNHNKALAEQQFGYNLQLAQQNATLTKDINQFNQQLELSKYTNAGFSSADAAMLSKSLSSGLSPTRVLTSAGVKVYASGAPTSYLTSGRQISSGIQTMYSALSAKSSKTPTVYKWVNNPLNYDTLSIGSQASSKAPTLSRS

SEQ ID NO: 284 - protein, 270 aa, WUHARV Calicivirus 2 contig00011_7
GPEDKTFYQNKIGEKYPYSITRSNCLHSILQTIGVSYVHYKDKPLPAQFYTHVQDWNENRYDVGGTKSGWTQQLLEIVYLIVKDVNWAKICMDFKPLNLWHNWKTMKPTFKGVLAFLTRVAELWGINISSLVTFLTSSLIPQSPFSPSFLMKVVLGALGFCTSYIFKKSLNAFSSVLRNFNKFIQNWTEFGTHSEFGVRILETITGTIPPWKPHQESISEVLDDLTHGKVQTGDDVSTRLQKLSDTIKDLSVMACDPSAPPEVAQAIKQA

SEQ ID NO: 285 - protein, 1447 aa, WUHARV Calicivirus 3_1
MDKSIDSVLSESSPICGADIQKLIFGNTSKVSYDRRPEPKIGQVIVLDEGDCFHYAVYVERGLLFSTGGMIGNGAFRYNGLTHPWGTLDLYGPGDKSFYDSKIGEKFPYSLTRSNCLHAILQVIGVSYVHYKDKPLPTTFYTHVQDWNENRYDVGGTKSGWTQQLLEIVYLIIKDVDWAKICMDFKPLNLWHNWQTMKPTFRGVLAFLTRVAELWGVNISKLITFLTSSLLPQSPFSPSFLMKLVLGAMGFCTSFIFKKSLNAFSSVLRNFNKFIQNWTEFGTHSEFGVRVLETITGTVPPWKPHQESISEVLEDLSHGRVQTGDDASTRIQKLSDTIKDLSVMACDPSAPPEIAQAIKQAQDVKKALEKTMMNTAHRRRPIVVVLAGPPGCGKTTFAKHLATHCAKELKTGVYSHTPGVDHWDAYDNQGVMIWEDFGATNAEEERKLFQRLADTMPVTLNCDRLENKGKFFTSTVIILTTNLEDISSGNCRMATLRRVDFHYHVTSFAVEHWQKGGCNGPKPYKDDFSHLTIKQLPKFATNFHGASLFGQWKPQPVSPNTVQVNTLAVWKMQSDEYPEQTVGWLMLQLGCSYFAGLRHVNDLRRGVIPRIAYTGGDIKCTVMGYKLDLYSLDGFLTGTIEHGDKKMSNEVYYDCDSGAEIKIDPTPYATRLNEWKLGVSLHWLLTKLVTFFLKANAVQDSNDTAASMAVFEAKGKNKKGRGARKLRSKVSKRYKFSPQEYNEFLKRRDEAAGRGIVYTVDDFLDDIGANSEGEEEEWWDPDGDFKQRHNLDYAPADDYYDEGYVCSFVYPATSDGVKKGCATQVSGSLFLTATHVAKTCDKIRGMPFKIIKMDGELCLVDVPGVKSQGKLDISFPTTGEVVNLCPARGSQRPNIPVIVRSIGNTNIAGKFLNVFTGTVVAAGKKSDGLGSEPGDCGSPYIKFVNGKPTLIGIHTAGSFSTNQVAGLVIPTRFNLEGKTTFVPKKIPPETTQIWYTKYSEEVEAEMHPPLVGTKDPRNPTPTSRILEEMFKPYTIPNAGRVNQADLIAAADAVRVKLQGLIRTRITLSAENAFETLDPTTSSGYPLYCKKDRSLPGVQATIDRVQGWLDGKVKLHRPIYTAALKDEPVKQSKLDEGKKRLLWCAPLETSLACAALMTDIASQLKIMRGDWPGKVGMNPTVEWWFLDQSFGPNVLCVDYSRWDSTMIQSIYEMGVKTLFGLSDHPKAPELIDLLCQPRKVIVNDELRTVYQGLPSGIPTTSLLNCVCHWIATTIAVAYAAKISIAEAVNWPLAVYGDDEVINCPCSNFAVRYANEMRRMGFHPTNPDKSEFFHPVHKSKMEFLSRTTNYVGGRCVGALKKSSIERQLYLTRGPQHNNPLEIGYPGPWFGEQLMCVMGEASLHGEAYFNVMRDKCARAACLAHVKFEPWPFWPTFMWATQNDIGCSGFV

SEQ ID NO: 286 - protein, 534 aa, WUHARV Calicivirus 3_2
MEPTTKTETTEVTGATGVTINSVAAPLPEASSDLSLAPTINPIDPWIFLNPTEVPGGTFTVASSTQPGTTLLELEISPELNIYTSHMFRMYAGWSGGFTLKLLVAGNAFTAGKLIAAVIPPNIPVPQSAYMLTAFPHEILDFRTADSLEIIAPDIKNVSYHFRGDKLAKLVIMVYSPLRSTNTDFDIEVKLTAAPLPDFKFTMLVPPTQSTALPIWNVPPAPPYSMINPRSPMTPIVELYVDPKYNTCNHQLGRYDITAGAIGNSTFNPAGAWMATYTAEAGSVPGNTDWHVALIDNPDNPTQDPSLPPLPRGFCDWGSGVRAGDKQHLVCFTGVKVDGGFKDVDAHMFDFGDNKTVGLDDTYQRQIYVIDSTLQANKQYIIIPMGVSGAANDDTVQVAPKCYGSWSYAPTISPPLGEQFVWFRSSVPASKTADRVNSVPVNVCSLMSPDLIRSAYASGFPEGKVALLDYVLYGGSVVRQFKMYPEGYLTANAAGNGGLVIPPDGTFRFNSWVSPSFNIASVVDLNTTATLSFR

SEQ ID NO: 287 - protein, 204 aa, WUHARV Calicivirus 3_3
MAGAAFASGLGQAAGGIFGSLISGAIQAGLNEQQFSHNRQLAEQQHGYNLELAKQQGEISKDLSAYNQQLDLSKYLNAGFSASDAALLSKSSPSSVLPTRVLTHAGVKTYAANNPTGYLSSGMQLSSGIKTMYDAVKASKSKSRTPTVYNWVNNPLNYDSLSINSSVGLSRRPSTISTSSSLSTTSSNSLSKYSTWGSYMDYKA

SEQ ID NO: 288 - protein, 627 aa, WUHARV Dependovirus 1 contig00007_Dependo_80
RAAAMPGFYEIVIKVPSDLDEHLPGISDSFVNWVAEKEWELPPDSDMDRNLIEQAPLTVAEKLQRDFLVQWRRVSKAPEALFFVQFEKGESYFHLHILVETTGVKSMVLGRFLSQIRDKLVQTIYRGIEPTLPNWFAVTKTRNGAGGGNKVVDECYIPNYLLPKTQPELQWAWTNMEEYISACLNLAERKRLVAQHLTHVSQTQEQNKENLNPNSDAPVIRSKTSARYMELVGWLVDRGITSEKQWIQEDQASYISFNAASNSRSQIKAALDNAGKIMALTKSAPDYLVGPALPADIKTNRIYRILELNGYDPAYAGSVFLGWAQKRFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLEDRMFKFELTRRLEHDFGKVTKQEVKEFFRWAQDHVTEVAHEFYVRKGGANKRPAPDDADKSEPKRACPSVADPSTSDAEAAPVDFADRYQNKCSRHAGMLQMLFPCKTCERMNQNFNICFTHGTRDCSECFPGVSESQPVVRKKTYRKLCAIHHLLGRAPEIACSACDLVNVDLDDCVSEQ

SEQ ID NO: 289 - protein, 197 aa, WUHARV Dependovirus 1 contig00007_Dependo_91
SHHSSPTPPRESVKRAINQPKKDLTLRRTLEPETDPLKDLIPAPCLQTLKCVQNRAEILSMRDKVPMEWVMPRVIGIAIPPGLRAKSQPPQPEPGSCPPTTTTGTCGSEPRSTATHTTDSPPPGDTLTSTDSTATSHHVTGSDSSTTTGDCDPKPCGSKSSTSKLRRSQRRTARLRSLITLPARFRYLRTRRMSSRT

SEQ ID NO: 290 - protein, 737 aa, WUHARV Dependovirus 1 contig00007_Dependo_105
LKPGMAADGYLPDWLEDNLSEGIREWWDLKPGAPKPKANQQKQDHGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPLESPQQPDSSTGIGKKGNQPAKKRLNFEEDTGAGDGPPEGSDTSAMSSDIEMRAEPGGNSVDAGQGSDGVGNASGDWHCDSTWSEGKVTTTSTRTWVLPTYNNHRYMRLGTTFNSNSYNGFSTPWGYFDFNRFHCHFSPRDWQRLINNNWGLRPKAMRVKIFNIQVKEVTTSNGETTVANNLTSTVQIFADSSYELPYVMDAGQEGSLPPFPNDVFMVPQYGYCGIVTGESQNQTDRNAFYCLEYFPSQMLRTGNNFEMAYKFEKVPFHSMYAHSQSLDRLMNPLLDQYLWHLQSTTSGQALNQGNAATTFGKIRSANFAFYRKNWLPGPCVKQQMFSKTASENYRIPSSGQDSLLRYDTHYTLNNRWSNIAPGPPMATAGSSDGNFSNAQLIFPGPSITGTTTNTADNLLFTSEEEIAATNPKDTDMFGQIADNNQNATTAPITGNVTAMGVLPGMVWQNRDIYYQGPIWAKIPHADGHFHPSPLIGGFGLKHPPPQIFIKNTPVPANPATTFTAARVDSFITQYSTGQVAVQIEWEIEKERSKRWNPEVQFTSNYGNQSSMLWAPDSNGKYTEPRVIGSRYLTNHL

SEQ ID NO: 291 - protein, 147 aa, WUHARV Dependovirus 2 contig00017_71
RVAEKEWELPPDSDMDLNLIEQAPLTVAEKLQRDFLVEWRRVSKAPEALFFVQFEKGESYFHLHILIETTGVKSMVLGRFLSQIRDKLVQRIYRGIEPTLPNWFAVTKTRNGAGGGTRWWTSATSPTTCCPRPSLSSSGRGLTWRSI

SEQ ID NO: 292 - protein, 484 aa, WUHARV Dependovirus 2 contig00017_84
WRRRGNKVVDECYIPNYLLPKTQPELQWAWTNMEEYLSACLNLAERKRLVAQHLTHVSQTQEHNKENQNPNSDAPVIRSKTSARYMELVGWLVDRGITSEKQWIQEDQASYISFNAASNSRSQIKAALDNAGKIMALTKSAPDYLVGPNLPLDIRDNRIYRILELNGYDPAYAGSVFLGWAQKKFGKRNTIWLFGPATTGKTNIAEAIAHAVPFYGCVNWTNENFPFNDCVDKMVIWWEEGKMTAKVVESAKAILGGSKVRVDQKCKSSAQIDPTPVIVTSNTNMCAVIDGNSTTFEHQQPLEDRMFKFELTRRLDHDFGKVTKQEVKEFFRWAQDHVTEVAHEFHVRKGGAKKRPAPSDADISEPKRPHLSVAQPSTSDAEAAPVDYADRYQNKCSRHAGMLQMLFPCKTCDRMNQNCNICFTHGARDCSECFPGASESQPIVRKKTYQKLCAIHHLLGRAPEIACSACDLVNVDLDDCVSEQ

SEQ ID NO: 293 - protein, 227 aa, WUHARV Dependovirus 2 contig00017_93
SPHRSVLPTPPRASARKASSPRKRDSILGRLATQSQCPTLNQSENHQQAPLVWDLVQWLQAVALQWQTITKAPTEWVVPQEIGIAIPHGWATESSPPAPEPGPSPPTTTTSTSKSPTGHREEAPTTTPTSATAPPGGILTLTDSTATSHHVTGSDSSTTTGDSGPRDSTSSSSTSRSRRSRRMKAPRPSPITLPARFRSLRTRNTSSRTSSALRTRAACLRSRRTSS

SEQ ID NO: 294 - protein, 742 aa, WUHARV Dependovirus 2 contig00017_106
LKPGMAADGYLPDWLEDNLSEGIREWWNLKPGAPKPKANQQKQDHGRGLVLPGYKYLGPFNGLDKGEPVNEADAAALEHDKAYDQQLKAGDNPYLRYNHADAEFQERLQEDTSFGGNLGRAVFQAKKRVLEPLGLVESPVKTAPGKKRPVEPSPQRSPDSSTGIGKKGQQPAKKRLNFGQTGDSESVPDPQPIGEPPAGPSGLGSGTMAAGGGAPMADNNEGADGVGSSSGNWHCDSTWLGDRVITTSTRTWALPTYNNHLYKQISNGTSGGSTNDNTYFGYSTPWGYFDFNRFHCHFSPRDWQRLINNNWGFRPKRLNFKLFNIQVKEVTQNEGTKTIANNLTSTIQVFTDSEYQLPYVLGSAHQGCLPPFPADVFMIPQYGYLTLNNGSQAVGRSSFYCLEYFPSQMLRTGNNFEFSYQFEDVPFHSSYAHSQSLDRLMNPLIDQYLYYLSRTQSTGGTTGTQQLLFSQAGPNNMSAQAKNWLPGPCYRQQRVSTTTNQNNNSNFAWTGATKYHLNGRDSLVNPGVAMATHKDDEERFFPSSGVLMFGKQGAGKDNVDYSSVMLTSEEEIKTTNPVATEQYGVVADNLQQQNAAPIVGAVNSQGALPGMVWQNRDVYLQGPIWAKIPHTDGNFHPSPLMGGFGLKHPPPQILIKNTPVPADPPTTFNQAKLASFITQYSTGQVSVEIEWELQKENSKRWNPEIQYTSNYYKSTNVDFAVNTEGTYSEPRPIGTRYLTRNL

SEQ ID NO: 295 - protein, 221 aa, WUHARV Dependovirus 3 contig00030_Dependo_31
NPPTPPRASARKASSPLKRSSTLGRLATQSQCPTHNLSENLPPRPQVWDLVQWLQAVAHQWQTITKAPTEWVMPPEIGIAIPHGWATESSPPAPAPGPCPPTTTTSTSKYPASQQGAPTITSISATAPPGGILTSTDSTATSHHVTGSDSSTTTGDSGPRSSTSSSSTSKSRRSQRMTALRPSLITLPARFRSSRTRNTSCRTSSALRTRAACLRSRRTCS

SEQ ID NO: 296 - protein, 602 aa, WUHARV Dependovirus 3 contig00030_Dependo_41
RVLEPLGLVEEGAKTAPGKKRPIESPDSSTGIGKKGQQPAKKKLNFGQTGDSESVPDPQPLGEPPAAPSGLGSGTMAAGGGAPMADNNEGADGVGNASGNWHCDSTWLGDRVITTSTRTWALPTYNNHLYKQISSQSAGSTNDNVYFGYSTPWGYFDFNRFHCHFSPRDWQRLINNNWGFRPKKLNFKLFNIQVKEVTTNDGVTTIANNLTSTVQVFSDSEYQLPYVLGSAHQGCLPPFPADVFMIPQYGYLTLNNGSQSVGRSSFYCLEYFPSQMLRTGNNFTFSYTFEDVPFHSSYAHSQSLDRLMNPLIDQYLYYLARTQSNAGGTAGNRELQFYQGGPTTMAEQAKNWLPGPCFRQQRVSKTLDQNNNSNFAWTGATKYHLNGRNSLVNPGIAMATHKDDEERFFPSSGVLIFGKTGATNKTTLENVLMTNEEEIRPTNPVATEEYGVVSSNLQSSSTAAQTQVVNSQGALPGMVWQNRDVYLQGPIWAKIPHTDGNFHPSPLMGGFGLKHPPPQILIKNTPVPANPPEVFTPAKFASFITQYSTGQVSVEIEWELQKENSKRWNPEIQYTSNFDKQTGVDFAVDSQGVYSEPRPIGT

SEQ ID NO: 297 - protein, 381 aa, WUHARV Dependovirus 4 contig00061_Dependo_13
GVSATVRARLCTPGMLASFPADVFMIPQYGYLTLNNGSQALGRSSFYCLEYFPSQMLRTGNNFQFSYTFEDVPFHSSYAHSQSLDRLMNPLIDQYLYYLVRTQTTGTGGTQTLAFSQGGPSTMANQARNWVPGPCYRQQRVSTTTNQNNNSNFAWTGAAKFKLNGRDSLMNPGVAMASHKDDEDRFFPSSGVLIFGKQGANKDGADSSQVLITDEEEIKATNPVATEEYGSVAINNQNASTQAQTGLVHNQGVIPGMVWQNRDVYLQGPIWAKIPHTDGNFHPSPLMGGFGLKHPPPQILIKNTPVPADPPLTFNEAKLNSFITQYSTGQVSVEIEWELQKENSKRWNPEIQYTSNYYKSTNVDFAVNTDGVYSEPRPIGT

SEQ ID NO: 298 - protein, 57 aa, WUHARV Dependovirus 5 GZXIHWF02F90YN_4
TLSKNCAECFPSEAPQVVKKTYKKLCAVHHIMGRAPEIACSACDLVNVDLDDCISEQ

SEQ ID NO: 299 - protein, 45 aa, WUHARV Dependovirus 5 GZXIHWF02F90YN_9
WYLPDWLEDNLSEGIREWLNLKPGAPQPKANQQKQDNARGLVLPG

SEQ ID NO: 300 - protein, 165 aa, WUHARV Dependovirus 5 GZXIHWF01CFM8N_15
FGPATTGKTNIAEAIAHAVPFYGCVNWTNENFPFNDCVDKMVIWWEEGKMTAKVVESAKAILGGSKVRVDQKCKASAQIDPTPVIVTSNTNMCAVIDGNSTTFEHQQPLQDRMFKFELTHRLEHTFGKVTKQEVRDFFRWAQDNDVPVTHEFYVRKGGANKRPPP

SEQ ID NO: 301 - protein, 35 aa, WUHARV Dependovirus 5 GZXIHWF01BRKBZ_4
SLANLTHVSQTRDENKENLIPNSDAPVIRSKTSAR

SEQ ID NO: 302 - protein, 77 aa, WUHARV Dependovirus 5 GZXIHWF01BTC0A_3
QSLGTFTTIWTNICPELLTVFVNWVADKEWELPSDSDMDISLIEQAPLTVAEKIQRDFYVEWKRVSKASEPLFFQSI

SEQ ID NO: 303 - protein, 84 aa, WUHARV Dependovirus 5 GZXIHWF01BTC0A_6
ARPRSHCFFNQFEKGDSYFHIHMLIETTGVKSMVLGRYLTQVKDRLVARIFRNVEPTMPNWFAVPRRVMAPEGGTRWWTSATFP

SEQ ID NO: 304 - protein, 143 aa, WUHARV Dependovirus 5 contig00278_6
AKRARIPPEKDSISGRLEKQSQCPTLNLSENLPQTPLVWDLVQWLQVVAHQWQTITRVPTEWVIPREIGIAIPHGWATELLPPAPEPGPCPPTTTTSTSKSPANRVPATTTTTSATAPLGGILISTDSTATSHHVTGSDSSTT

SEQ ID NO: 305 - protein, 279 aa, WUHARV Dependovirus 5 contig00278_7
PLERLSPRPTNKNRTTLGVFVLPGYKYLGPFNGLDKGDPVNEADAAALEHDKAYDKQLADGDNPYLKYNHADAEFQERLQKDTSFGGNLGKAVFQAKKRILEPLGLVETPAKTAPGKKRPVEPSPQRSPDSSSGIGKKSPHPARKRLNFGQTGEAESVPDPQPLGEPPSDPSSVGSGTMAAGGGAPMADNNEGADGVGNSSGNWHCDSTWMGDRVITTSTRTWALPTYNNHLYKQISSQSGASNDNHYFGYSTPWGYFDFNRFHCHFSPRDWQRLINNI

SEQ ID NO: 306 - protein, 147 aa, WUHARV Dependovirus 5 contig00538_6
RPVTGEVDSQGVLPGMVWQDRDVYLQGPIWAKIPHTDGHFHPSPLMGGFGLKHPPPQILIKNTPVPANPATTFTPGKFASFITQYSTGQVSVEIEWELQKENSKRWNPEIQYTSNYNKSVNVDFTVDTNGVYSEPRPIGTRYLTRNL

SEQ ID NO: 307 - protein, 90 aa, WUHARV Papillomavirus 1 GZXIHWF02H3IYD_11
HRYSETDSGRVRVSRLGRRGTIFTRSGTQIGQNVHFYYDLSTISSDTIDAIELGPLGQHSGDSVILNPIAERLLLMELQTQMLHTLRKNY

SEQ ID NO: 308 - protein, 60 aa, WUHARV Papillomavirus 1 GZXIHWF02H3IYD_13
ETFIDGIANADVTYTEEELLDPLIEDFSSSHLVLSSSGRRGSVYTVPTLPPGLGLKIFVD

SEQ ID NO: 309 - protein, 653 aa, WUHARV Parvovirus 1_1
VFVFKIHDCIYKPTKDGQGPKITWRDYRKPSKHPDIQEVYKLDQQTVSTRDPEPDSEINIDGTPFKQGIILTSLVKKILFDYFKTKNIIPEEIDWFMQTEYSENTELHIHVILHSDKIDSKSGKWMCKYFGEKWGLMLCTVLNMPKENLSDFFNQTKFRQTVENDEWVQVLQYTHPQTKKKYCKPVNFGEIIHTYFLSKKPILQKANGECGYIYSSDSGFRMNSLCFNDRWLIHQHLRELSMRKETTQIQTISPQDKKKKRLETAKEQSIKETIYTLTKNKLHTAEKWMLGDPDSYIQHIANPGGETVIKATLDIVTLKMSVEKTAYQLIIESKHEKIKHIKKCKAWKLMKDNNFNPKKIWHCISCALNKQMGKRNTILLCGPASTGKSLLAQKIAQLVGNVGCYNPSNVNFPFNDCSNRNLIWVEEAGNFGGQVNQFKAIMSGQSIRLDQKGKGSKAIEPTPVIMTTNEDITKVIIGSETKPEHKQPIMDRCCRIEMKKRLEGDFGLLEDGEIPSIFKWLESKAFLPTMANYCARWGAPPTWGENWNTKPKELGTELISDEETEPETSKPNLYQSLDPTGLNADFQLLLQDIEETEKQYQQYMEPTDEEIAELAETGYGQALIDGTAIQSSTSRGPLNASNKKGIRGKSLSL

SEQ ID NO: 310 - protein, 684 aa, WUHARV Parvovirus 1_3
KFKLQKKPTNPSDAAARKHDLEYNKLIQQGHNPYFYYNHADEDFIKETNQAKDWGGKFGNYIFRAKRALAPELAPPKKKSKTEKGEPSYSYKNIKPGTKRGKPFYLFVNLAKKKRMSAPAAENNDQQPDAAEPSVAGAKATGGGGGGGSGVGHSTGSFNNRTEFIYHGSEVTIICHATRHIHLNMPDSEEYKIYETNRGPRFPTDQTLQGRDTINDSYHAKVQTPWQLLHANCWGCWFSPADWQQMITTCREFKVEHLEQAIDNIVIKTVTKQGTGAEEITQYNNDLTALLQVAEDKSNLMPWAADNMYIDSIGYVPWRPSKLPTYCYHVNFWNTIDINAGAQQNQWAEVKKGIQWDNIQFTPIENMVDIELLRTGDRWDSGPYTFYCKPSSLEYHWQSTRHTGSCHPSTTPQAIGSVGNNLETLNAWQWGDRNNPSSASTRVSNFHIGYSWPEWQFHYSTGGPVVNPGQPFSQAPWGSEVAGTRLTQGASEKAIYDWNHGDEEHQFRETWWQNNENMTGQTNWAPKNIHQKELTNNVAAQTAFWAQGYHNTFGPFTAFDDHGAQYPWGAIWGKEPNTTHKPLASSHAPFMTANPPGQIFVKLAPNYTDTVDNNGNSSRIVTFGTFWWTGKLVIKAKLRTPRQWNTYQLPSLAARETMKETVPNEIGNFEIPYMPGRAMPNYTL

SEQ ID NO: 311 - protein, 159 aa, WUHARV Parvovirus 2 GZXIHWF01BFLV1_15
QSTPGNGETETIQAAPLPEYPNFHIGYSWPEWQFHYSTGGPVVNPGSAFSQAPWGSEVGQTRLTQGASEKAIFDWNHGDDTTGARETWWQNNEHMTGQTNWAPRNIHQKELNNNVARADAFWTEGYHNTFGPFTAVDDHGPQYPWGAIWGKEPNTTHKP

SEQ ID NO: 312 - protein, 230 aa, WUHARV Parvovirus 2 contig00138_9
TNYCYHVDFWNTITINANPATWTQTKTGIQWDNIQFTPIENMVAIDLLRTGDSWHSGPYTFKTKPTSLEFHWQSTRHTGSCHPSTTPSTIGGIGNNNNSINSWQWGDRNNPSSASTRVSNFHIGYSWPEWQFHYSTGGPVVNPGSAFSQAPWGSEVGQTRLTQGASEKAIFDWNHGDDTTGARETWWQNNEHMTGQTNWAPRNIHQKELNNNVARADAFWTEGYHNTFGP

SEQ ID NO: 313 - protein, 561 aa, WUHARV Picobirnavirus 1 contig00041_26
LKTSLHWVDHCPPCYMNRRYSNMATRKPKKTRQPNWRARAPKNSGDKAALDSDARFMEQASERKKGNDISYYNHSPEMLQMAGKFSFANALGGFLPDKSLTKEPIDDKFAIYRSVEDSSKFINQAIGTVTVPGIMTFETALVPGFSTNNESVVNIAARQLYTAVRAQQTTKFDFDVPDLMMYCLTMDNVYSYYVWMQRLYGIMNNYQVLNRYAPDDLIRANHVDPVDLRKHMADLLFYLEQFVVYAKPYSIPSDIMYFRRHGEMFANVYKDGMGDKAQLYMFVPYGFFKFNETSSEAPIGALSLQPIGLTTNNSFKLMTFDDIVTYGNALLDGIRYSEDAANISAALIKAFSYETYAFSQTDRSYLVQPVYNEEILLQIHNCRSVGPLSTGADITQDKTTNAILFTPAISASIQQEQLIDSWYSDPTPEQVMTMTRFSGVIQSGGDQSSGMFGAELICNMVVYKRFFERRTATDTVVKLGFYRFQSEYQLTNTANDHVPAIMNMISALTDISRFDWAPLIYRKIDDSLGAGAARVTAVNEIFGDLENYTTISAEDLRKLHE

SEQ ID NO: 314 - protein, 146 aa, WUHARV Picobirnavirus 2 contig00009_3
PQRYNTLYLGETERSHRATEDLRSQELTEVARSNLARETETNRSNLAQEQETYRSNKARERETSRSNRAQERELVRSHQVAEREIERSNRAREIENTRSSKLEKLRAIGPTSRMKTLSDQPITLMLYNRQKRKDQICVTKNYVIMT

SEQ ID NO: 315 - protein, 515 aa, WUHARV Picobirnavirus 2 contig00009_16
EKEKIIMSKNQTETTTNSKNSDKGRNNNNRRRPNPNRNNNRPKEKENKSVFDKGCERTQYGNDVSWYSKNPELMKSASSLPFSYTTGQRLPFTGTTSVPGILRVTYVPNMGYSYIEGSIPHDAEAFANSAVNLAAKSIYSYTVHANSRNQSYDATDEMLIILAGSQVFSMIAHAIRAYGVMRTYAQQNYYMPRALVKALGFDYTDIVKNMSKMWFDINQMIAQVSQIWIPNTLPLTKRWFWMNSNIFTDAPGIKSQMYLFVPDKFYIYDETSDPNGGKLVANNWRADANFTWEEYVDMVNVAINALLNSQDRGIIMGDILKAYGADSIYTLTEIDSSYTLLPVYDTEVLTQIENSTSMANVASEIRQSEEGYLYMYAAASETTPNRQTIPMFNSVLNYHIAQEPTPDMNMVATRLKNHGVYYVHTPEGGQITNVVANSDASEIVVGYDIYQYGDNGTIEVIPMHSVWVGSDITAVVKGLTAWSAFDWAPWIYFIDDATYTKWINGQVPAPDVTLR

SEQ ID NO: 316 - protein, 411 aa, WUHARV Picobirnavirus 3 contig00061_19
KFLLVTQVGTKMSWNSDLFNSEHVIPGVMQMAMTTIPGIARTSSDGVNLAAQSLFTRVRKDLSTTASYAPADIAMYVMAMDGLFQTYAHIRRIFKLFNLYSSVNLSYPTTILRACGFTDDAIAEARGNMNQLRSYFNQLIYKAAALYLPVGFSLIDRHTWLFSNVFIDSMNPKAQIIIHVPNAYWLLDETVSDQGTALRPIYTRIKDTVRLPDLLEMFELQIEAIRNSDSMWKIQADMRRAFNDSTGRYVMALIDENELIDPVYSKEVLSQIENTTICPHLPTDKTFIPSWYITQSVNKNILLFTPKWKISEQFSWIQQDVDKTYSANRILNMHWENPTADDIAVATRNMDFIRATDENTMELTSAGSDICTGCVIYKYNDKISDIRSFNSSANMTPQVVADWAAFDWAPP

SEQ ID NO: 317 - protein, 279 aa, WUHARV Picobirnavirus 4 contig00030_34
GGIYMTANQINYQRNLIQHRANAEQERTNKANEYIQTVRNLETQRHNVAAEEQARNELSESQRHNLAGEDLGRNTLAESMRHNMVGEQETNRHNLAQETETNRHNTADESERHRSNVANETIESNKLAESIRHNMTTESETTRHNRVSEGIEQTKAATGQYNAETNRLNAQEALRHNFMSEAIISKNNEMNWAQTARGLQLKNDLNQITKRYNDQKIQIEQAKVLLEEALNSGKLNKMEADTAQGWVNIAIKGLEAISKAKGGASGTALQLFKLLLTLE

SEQ ID NO: 318 - protein, 239 aa, WUHARV Picobirnavirus 4 contig00030_38
HLNKKGVSYMARKVNKANEKFDKRRGYDEDIQSGKGKNYRGSKAGASQNSKLYGNHIEWYARNSQLLADSASFAYGWPAGNAIDLNSKYSTTSIPKYSVPGVMALRFVPTIGISRDRTSPINVAATNVYTFVRHANSGHANYDAPDLMMYLLAVDSGYMLHAFMRRIYGLCSLYSATNRYYPRAIIESMGVNFDDIIANLPNFRYLINRFAVQMGALCIPSDMSYHRRHMWLCDKYLCR

SEQ ID NO: 319 - protein, 232 aa, WUHARV Picobirnavirus 5 contig00107_31
LERMEKIMKNENKERSNETSREGFYNKATSEKSNNKRSRQNSKSKRNSAKPSSRFCDTGSNKVGNDPNWYNNNDQLLKDAASFSYFYPAGSKIDLQRTTTELTNILAGINDMGVMACATLDAPGCATDQYSPVNVAARQIYTWVRHANSGHTNYDAPDLMLYILSMDSAYAMYAYMVRAYGCLQLFSQVNRYYPKGIMEAFSLDYDDFIANLADFRYFINSYAYKLASLAVP

SEQ ID NO: 320 - protein, 213 aa, WUHARV Picobirnavirus 6 contig00044_12
NMNEKQNRRNENYEEDKSTNRGSGKGNKSKRGFAKRGKSMDSDRNRSRVSSNSGKNGKSNMKNDESWYLRNPELTQTATAFNLLYPTGVSFNLLDSHATVGSEAIKMNPTNLAGVCAFRYIPSIGYAASSTDPVNVATTKIYAYVRHMNSGHTNYESADLMLYLLQMRQCYSWYMWMTRLYGVLNSYSALNRNLPKALVAAMGVNYDDVISNM

SEQ ID NO: 321 - protein, 378 aa, WUHARV Picobirnavirus 7 contig00065_12
FFEYHTVPGIATDRASAINVAANNIYQYVRHANSGHTNYDPQDYMLYLLGMDSLYAYYAWMIRIYGLAQAYSMTNRYVPKTLLQSLNIDCDNIQKHGNDLLYFINNAARKMNSFAVPGGMSYYERHIWLNSHVWADDTSEKAQYYMYNPSGFYKFEEVASTKGGKLSYVRMDELVGGTKGTLYTIENIAKGFNTLYDAIMASEDCGIMMGDTLKAFGSNIIQVAPVDSNYQVFPEYNEEVLGQIHNIETTGTLLSDSVEQDPDKNMLVCRPNASTSALDGLEHLLDCKSSAPDGATIMVDTRLKPIVERLGDSQTTNTLTSCGSEVVEMVKMFYNCFDREGVSKFKEDRFPLNGILYVPNDATIMQAVASLTQRCDRL

SEQ ID NO: 322 - protein, 105 aa, WUHARV Picornavirus 1_12
LMMDQDRLHNATIHVRTTWGPKPTQRDSFEWQSATNPSIFTRMTDPPAQVSVPFMSPASAYQWFYDGYPTFGQHTASTDSWYGVCPNNLMGTFAVRAVGSGNIKA

SEQ ID NO: 323 - protein, 2191 aa, WUHARV Enterovirus 1
MGAQVSTQQSGTHENTNVATGGSTIHYTTINYYKDSYAASANKQDFSQDPSKFTQPVVDVLKESSVPLKSPSAEACGYSDRVCQMTVGNSTITTQEAANVVVGYGEWPEYCSDTDATAVDKPTRPDVSVNRFYTLAAKLWESNSKGWYWKFPDVLTETGVFGQNAQFHYLYRSGFAVHVQCNASKFHQGTLLVACLPEYTNGRSDANTTPADAKHPSFEATQPGPNGKELAFPYVLDCGVAVSQLLVAPHQWINLRTNNCATIIMPYANAVPYDSALNHCNFGLFVIPIAPLAFSEGATSAVPITVTIAPLCAEFAGLRNAVTQGLPVELKPGSNQFLTTDDGVSAPILPGFHPTPLIHIPGEVNNLLQLCQIESILEVNNVASVAQMNRLLIPVSVQSAVDQLCASFRVDPGRDGPWQSTMVGQLCRYYTQWSGSLEVTFMFTGSFMATGKLLIAYTPPGGTQPRDRATAMLGTHVIWDFGLQSSITLVIPWISNTHFRTNAAGTYFDYYTAGIVTIWYQTNFVVPSGAPTSAYLIALGAAQPNFTMRLCKDTDEISQTAVLQGDIKDMLETHINSTAHKVLSNVNGGSTSTGADTDASSHSLTTGSAPALQAAETGATSVTSDESMIETRCVHNHHSVAETSLENFFGRAALVGMTTLLTSESTANGFTNWPIDIMGYVQQRRKLEIFTYMRFDSEFTFVCTDSTGQGPNVVVQYMYIPPGAPAPTTRDSFEWQSATNPSVFVKASDPPAQVSVPFMSPASAYQWFYDGYPTFGSHPASGDINYGISPNNLFGTFAFRVVGSENVTTKLTVRIYMRIKHVRAWIPRPMRTQPYILKNYPNFNGNNIKHMAKDRKSITTTGAFGQQSGAVYVCNYRIVNRHLATKHDWDNLEWEDYQRDILVSRTSAHGCDKIARCNCSTGVYFCKSMGKHYAVSFQGPGLVHVQANEYYPERYQSHVLLANGIAVAGDCGGILRCPHGVIGLVTMGGDGLVGFADIRDLLWLEDEVMEQGVTDYIKGLGDAFGTGFTESIAREVQNIKDTLIGSEGVVEKILKNLVKLISALVIIVRSEYDLVTVTATLALIGCTGSPWRWLKTKVASILGIPIAQKQSDSWLKKFNDMANAARGLEWIANKISKFIDWIREKIIPIAREKAEFINNLKQLPLLENQINNLEQAAASQESLEQLFGNIQYLAINCRKFQPLYAAEAKRVFSMEKRMVNYMQFKGKQRIEPVCLIIRGSPGTGKSLATSIIARAIAEKFNSSVYSLPPDPDHFDGYKQQVVTVMDDLCQNPDGKDISLFCQMVSTVEFIPPMASLEEKGIAFNSKFVIASTNSGNIIVPTVSDSEAIRRRFYMDCDIEVPDSFRLENGKLDAGRAAKLCSENNTANFKRCSPLVCGKAIQLRDRKSKVRYSLDSVISELIREYNNRMSVGNTIEALFQGPPKFRPLTISLDTPAPEAIADLLRSVDNEEVREYCKEKGWIIPEVPTNLERHYNRAIALIQSITTILAVVSMVYVIYRLFAGFQGAYSGMPKTAVKKPVLRTAVAQGPGLDFAISLLKKNIRKIQTEEGHFTMLGVRDRLAVLPRHAKPGKTIWMEGKQVTVLDAVELVDEQQVNLELTLVTLDMNEKFRDITKFIPESFEHCMDATLIINTEQMPSMFVPVGDVQFYGFLNLSGKPTHRTMMYNFPTKAGQCGGVVTSTGKVIGIHVGGNGKQGFCAALKRSYFATEQGEIQWMKPNKETGRYNINGPTQTKLEPSVFHDVFEGKKEPAALSAKDPRLEVDFEEALFSKYIGNAIHEPDEYIIQAAKHYSNQLKQLNIDTSRMSMEDACYGTENLEAIDLSTSAGYPYNALGIKKRQILDPTTRDVTKMKYYMDKYGLDLPFSTYIKDELRSSEKVKKGKSRLIEASSLNDSVYMRMCFGRLFEKFHENPGTITGSAVGANPDTFWSKIPILLPGSLFAFDYTGYDASLSPAWFRALEIVLRDLGYDDEAISLIEGINHSHHIYRNKTYCVVGGMPSGCSGTSIFNSMINNIIIRTLLIRTFKGIDLDELNMIAYGDDVLASYPFPIDCAELARTGREYGLVMTPADKSSCFNEVTWENATFLKRSFKPDEQFPFLIHPVMPMSEIHESIRWTKDARNTQDHVRSLCLLAWHAGREEYNEFVEKIRTVPIGKVLSIPQYDNLRRIWLESF

SEQ ID NO: 324 - protein, 2176 aa, WUHARV Enterovirus 2
MGAQISTQKTGSHENANLATGGSTINYTTINYYKESYAASATKQDFSQDPSKFTQPVVDVIKESSVPLKSPSAEACGYSDRVAQLTLGNSTITTQEAANITVGYAEWPEFCPDTDATAVDRPSRPDVSVNRFYTLSAKLWEKTSKGWYWKFPDVLTETGVFGQNAQFHYLYRSGFCIHVQCNSSKFHQGTLLVATIPEFLVARSDTATDPTTAKHPSYGAAQPGKSGKEFAFPYVLDSGVPLSQALIYPHQWINLRTNNCATIVVPYMNAVPYDSALNHCNFGLVVIPVAPLNYNAGATTAIPITVTIAPMCSEFGGLRNAVTQGIPVELKPGSNQFLTTDDEVSVPILPGFHPTPEIHIPGEVKNMLEIAQVESILEVNNLESNENDPMQRLLIPVSVQSAVDQLCASFRVDPGRAGPWEATLVGQLCRYYTQWSGSLEITFMFTGSFMATGKMLIAYTPPGAAQPTSREIAMLGTHVIWDFGLQSSVTLVVPWISNTHYRTQATNNYFEYYSSGIVTLWYQTNYVVPDGAPTSAYIIALGAAQPNFSLKLCKDTESIAQTAILQGDPESSLETFVEGQVSKALTAADTKPSTHKISTGDTPALQAAETGATSNTSDENMIETRCVVNKHSIAETSVQNFYGRAALVGYISVLTSDTTANGFTNWDIDVMGFVQQRRKLEIFTYMRFDAEFTFIATADDGQADSTMLQYMYVPPGAPKPTQRDSFEWQSATNPSIFTRMTDPPAQVSVPFMSPASAYQWFYDGYPTFGQHTASTDSWYGVCPNNLMGTFAVRAVGSGNIKANIRIRVYMRMKHIRAWIPRPFRSQPYLLKNYPNFNGAALKCTSKSRTSITTTGAFGQQSGAIYVCNYRVVNRHLATKEDWENLVWEDYQRDLLVSNTKAHGCDIIARCNCQTGVYFCKSQGKHYPVSFQGPGLVHVQENEYYPERYQSHVLLANGFSVAGDCGGILRCQHGVIGLVTMGGDGLVGFADVRDLLWLEDEVMEQGVTDYIKGLGDAFGTGFTESITREVQALKDHLLGSEGVVEKILKNLVKIVSALVIVIRSDYDLVTMTATLALIGCHTSPWAWLKSKVCSLLGLPIAQKQGDNWLKKFNDMANAAKGLEWIAVKISKFIDWLKQKVVPAAREKVEFLNNLKQLPLLENQVSNLEQAAASQDDLEALFGNVQYLAIHCRKYQPLYASEARRIATLERRVNNYMQFKNKQRIEPVCLIIRGAPGTGKSLATGIIARAIAEKYHSSVYSLPPDPDHFDGYRQQVVTVMDDLCQNPDGKDISLFCQMVSTVEFIPPMASLEEKGLPFTSKFVIASTNSSNIIVPTVSDSEAIRRRFYMDCDIEVPESYRLENGKLDASRAARLCSENNTANFKKCSPLVCGKAIQLKDRKSKVRYSLDSVVSELIREYNNRNSVGNTIEALFQGPPVFKPISISLTEPAPPAIADLLSSVDSEEVRQYCKDKGWIIPEVPTNIERHVNRAVVVLQSITTVVAVVSLVYVIYKLFAGFQGAYSGMPKTALKKPVLRTATVQGPCLDFALSLLRRNIRQVQTDKGHFTMLGVRDRIAVLPRHAEPSGTIWIEGKQVKVLDAVELVDEQQVNLELTLVTLDMNEKFRDITKFIPEDIEPVAEATLVINTEQMPSMFVPVGKVENYGFLNLSGRPTHRTLMYNFPTKAGQCGGVVTSVGKIIGIHVGGNGRQGFCAALKRCYFTTEQGEIQWMKPNSETGRYNINGPINTKLEPSIFHDVFDGKKEPAALSSKDKRLEVDFEEAVFSKYIGNKIHEPDEYMIQAAHHYANQLKQLNIDTSRMSMADACYGTENLEAIDLSTSAGYPYNALGIKKRQILNPETRDVTKMKFYMDKYGLDLPYSTYVKDELRSIEKVKKGKSRLIEASSLNDSVYTRMCFGHLFEAFHANPGTITGSAVGCNPDTFWSKIPILLPGSLFAFDYTGYDASLSPAWFRALEIVLKELGYDSEAVGVIEGINHSHHIYRNKTYCVLGGMPSGCSGTSVFNSMINNIIIRTLLIRTFKGIDLDELNMIAYGDDVLASYPFPIDCQELANTGKEYGLIMTPADKGSCFNEVTWENATFLKRGFKPDEQFPFLIHPTMPMSEIHESIRWTRDARNTQDHVRSLCLLAWHNGKEIYDQFVRQIRSVPVGLALSIPEYNNL

SEQ ID NO: 325 - protein, 2184 aa, WUHARV Enterovirus 3
MGAQVSTQKTGSHENANMAVGGSTINYTTINYYKESYAASATKQDFSQDPSKFTQPVVDMIKESSVPLKSPSAEACGYSDRVAQLTLGNSTITTQEAANITVGYGEWPEFCSNTDATAVDKPSRPDVSVNRFYTLSAKLWEKTSSGWYWKFPDVLTETGVFGQNAQFHYLYRSGFCIHVQCNASKFHQGTLLVAVIPEFTVARSDSSTDPTTAKHPSYGAAQPGKNGKEFAIPYVLDSGVPLSQALIYPHQWINLRTNNCATIVMPYINAVPYDSALNHCNFGLAIIPVAPLDFNTGATTAIPITVTIAPMNSEFAGLRNAVTQGLPVELKPGSNQFLTTDDEVSAPILPGYHPTPEIHIPGEVKNLLEIAQVESILEVNNLTTNENSPMQRLLIPVSVQSAVDQLCASFRVDPGRAGPWESTLVGQLCRYYTQWSGSLEVTFMFTGSFMATGKMLIAYTPPGGAQPTSREIAMLGTHVIWDFGLQSSVTMIIPWISNTHYRTQATDKYFEYYTSGIVTLWYQTNYVVPEGAPTSAYIIALGAAQPNFTLKLCKDTESISQTAILQGDSESSLEAFVEGQISKTLTAADTKPSSHNISTGNTPALQAAETGATSNTSDEGMIETRCVVNKHSVAETSIEHFYGRAALVGIVSILTSETTTNGFTNWDIDIMGFVQQRRKLEIFTYMRFDAEFTFIATAGDGKADSTMIQYMYIPPGAPRPTMRDSFEWQSATNPSIFVRMTDPPAQVSVPFMSPASAYQWFYDGYPTFGTHNASTDSWYGVCPNNLMGTFAVRAVGSGNITSNITVRVYMRMKHVRAWVPRPLRSQPYLLKNYPNMDGRNLKCASTSRSSITTTGAFGQQSGAVYVSNYRIVNRHLATEEDWENLVWEDYQRDLLVSNTKAHGCDTIARCKCQTGVYFCKSQNKHYPVSFQGPGLVRVQANEYYPERYQSHVLLASGVSKAGDCGGILRCQHGVIGLVTMGGDGLVGFADIRDLLWLEDDVMEQGVTDYIKGLGDAFGTGFTESISREVQALKDHLLGSEGIVEKILKNLVKIVSALVIVIRSDYDLVTMTATLALIGCHTSPWAWLKSKVCSFLGLPIAQKQGDNWLKKFNDMANAAKGLEWVAIKISKFIDWLKQKVVPAAREKVEFLNNLKQLPLLENQVSNLEQAAASQDDLEALFGNVQYLAIHCRKYQPLYASEARRIATLERRVNNYMQFKNKQRIEPVCLIIRGAPGTGKSLATGIIARAIAEKYHSSVYSLPPDPDHFDGYRQQVVTVMDDLCQNPDGKDISLFCQMVSTVEFIPPMASLEEKGLPFTSKFVIASTNSSNIIVPTVSDSEAIRRRFYMDCDIEVPESYRLENGKLDASRAARLCSENNTANFKKCSPLVCGKAIQLKDRKSKVRYSLDSVVSELIREYNNRNSVGNTIEALFQGPPVFKPIKISLTEPAPPAIADLLSSVDSEEVRQYCKDKGWIIPDVPTNIERHVNRAVAILQSITTVVAVVSLVYVIYKLFAGFQGAYSGMPKTALKKPVLRTATVQGPCLDFALSLLRRNIRQVQTDKGHFTMLGVRDRIAVLPRHAEPSGTIWIEGKQVKVLDAVELVDEQQVNLELTLVTLDMNEKFRDITKFIPEDIEPVAEATLVINTEQMPSMFVPVGKVENYGFLNLSGRPTHRTLMYNFPTKAGQCGGVVTSVGKIIGIHVGGNGRQGFCAALKRCYFTTEQGEIQWMKPNSETGRYNINGPVNTKLEPSIFHDVFDGKKEPAALSSKDKRLEVDFEEAVFSKYIGNKIHEPDEYMVQAAHHYANQLKQLNIDTSRMSMADACYGTENLEAIDLSTSAGYPYNALGIKKRQILNPETRDVTKMKFYMDKYGLDLPYSTYVKDELRSIEKVKKGKSRLIEASSLNDSVYTRMCFGHLFEAFHANPGTITGSAVGCNPDTFWSKIPILLPGSLFAFDYTGYDASLSPAWFRALEIVLKELGYDSEAVGVIEGINHSHHIYRNKTYCVLGGMPSGCSGTSVFNSMINNIIIRTLLIRTFKGIDLDELNMIAYGDDVLASYPFPIDCQELANTGKEYGLIMTPADKGSCFNEVTWENATFLKRGFKPDEQFPFLIHPTMPMSEIHESIRWTRDARNTQDHVRSLCLLAWHNGKEIYDQFVRQIRSVPVGLALSIPEYNNLRRLWLEQF

SEQ ID NO: 326 - protein, 2421 aa, WUHARV Sapelovirus 1
MAIYEDDSSESVQCCNWIPRNRRNKVRKQKPRSKASKVEMSPGPLVTLADDGYLYVHKHKGETKFVRRDEIVTKYGRCIVEMEEIFQCGQVQSNQTGNKPSSGYIYGTGNHLTNINYYGSDYSQAYNPSQQVMDPEKFTKPVTEIAGSLKGPSLKSPNVEEAGYSDRLMQLTSGNSCITTQEAAKAVVAYGMWPTYNIDAGEALDLDTKPGPSCDRFYTFDSLDWKDTQYGEWVCPLPGALMDTGVFGQNLRFHYLYRSGFCVHVQVNASQFHQGCLLVAMIPEHQTPKEQPNDFAYWEHKDMCGTEYPTEQLTLFPHQFINIRTNNSATIVYPYTNCTPSGFGLSHNFVTLVIRVVVPLSYNTGASTVVPITVSVAPMCSSFAGLRSAVKTQGIPVRLIPGSGQFLTVQRDAGIPLYPEFQKTKNFILPGRVNNLLEVARVPTMMKMPNTQADGTYLAVDVTQNFHTNAIGKWDMSLVGDMFKPTYLGRLAKMYANYRGSVEIEFMFCGSKMATGKFLIAYTPPGGSSPANREEAMLGTHVIWDVGLQSTVKFVIPYISTSAYRSSMLTNTTLSYDGWITMWYQTAIVVPPGAPNICQIIGLVSASDNFVFRIPSDNKYYTNNVNRQGEEDKVLKALQASVNTHIENALSTSPQKEIKHNGVEISQGDSAALTAAETGETSGSSGESTMELRETNVVFSTKETDLEYLYSRYFMYYQGTVTITKATTEGLTPMINKEITFDAVAASDPAITRWRAFTYWRFDLDVCVVIYPQINNNTSPQSMTFQIMFSPAGCEVPESYDSKVWLSPINPTVISKIQDPPTSFRIPFMSVCNYYTSRYNGSGAFDPNDKKYGVNPGNFIGNITIKMINDTVPNFTGSYGVRIYVRPVNIQAYMPRPLLAYRDGTVVEDYTRYTTVGTTQLGFEYDVDIKSPIGDMWNVDEFDWVNMSPTDILLERCYDVLSFSAQFDKGPFTAWWWKDDIIITSYHACNDWYKYLERKNPVFRYRISCSTSRWWKNPYLVEAVGVKQVWIDSFRDIAFIRVIPSNRIKARPGLIGENRVRHKNERKFEHCLCVTNSVVFPVRYTEYRNPQYCEILNFRDHQQKDLWSCRGDAEPGFCGSMLFSEGKAIGMLTAKSMCTYDNGDKVMTTFFTQLDTASFYRCVEVTKQDCFYAIQHEPAIQLGLEDPFGANTGYPDDLDDEIPLTFPEAHYQGLYDWIHEMGISFGDGAGESFQRNVDEAIEKITPIVSQFKGGVEGFLKDKLFNSLFSILVKVIGSLVVYINAKDECKLSTLLALGSMLGVDFLSKDPFTYLYEKFTGCVQMQGPSDWLKDFNIACNAFKGLEYIYQKLSTFFDWIKGLLKKNDDPARLEFHRMLEDWPEVMEKMDLIERNRKNYHDADVLEVCEFVITIKKLADTYGIERNMATTQIVKYHAKAQKLAQSIRSSRYEPVALCIHGSPGTGKSIATEVISRSLAQATDTQLPYSLPPDPKYFDGYSQQNVVVMDDLGQNPDGEDMSLFCQMVSTTAFIPPMASLEEKGTYFTSNFVCASTNCSSLKPPTVMEPAALQRRFYLDCDIIVGKDFSIDRKLDMSKCTPCLNCPKPENFKCCNPLICGKAILLQDRRTNVRYTLDKVVTIMLAESRRRRNILNVVDALFQGPSYEKPKLIRKQVVDKLLPEEVVEVLKEVPSEELIAKLKEKGYVFPIEVEVVRERNKVQKYLNWFTTVMSTLTTIVSFSTVVYMLVSVFAGKQGAYTGNIKPVIQKPVLRKAVVQGPDLEFAKSLMKTSLFPVCTSTGSYTALGLFDQWLVLPAHANPKDTIVFKGESVNILDSMLLESSRGNLELVVVKLDRNEKFRDIRKYLVENFHTEKECWLALNSDQFRDVYIPVGSVSLFGFLNLSMTATYNTLKYNYPTKVGQCGGIVVKAGKILGMHIGGDGVSGYSAMLKKSYFSVCQGEIVHKESTKEKGVKSINVKTKTGLYPSVFHDVFEGTKEPAALRPGDSRLKVDLNEALFAKYKGNKHISIPPETFIAIDHYVEQIRPLLPENLTEQLELEDVVYGVENLEGLDLNTSAGYPYNTMGIRKRDLIPLRGEPLTQLQKALDLHGYNLPFSTYLKDELRPKAKVEAGKTRLIECSSLNDTIRMKRIFGRLFQTFHSNPGTCTGSAVGCNPDYHWSQFASEIGTDNICAFDYTNWDASLSPFWFDALKVFLVKLGYGEGAIDAIDHICYSSHIFKDQYYVVHGGMPSGCSGTSIFNSIINNLVVRTLVLKCYKGINLDLLRILAYGDDLLVSYPFPLDPAVLADAGKELGLTMTPADKSDSFNGCSKLTEVTFLKRSFVFDDQFPFLCHPVFPMSEIHESIRWTRSAATTQEHVTSLCLLAWHNGKEVYEEFCEKIRSTPVGRALSLPSFEVLRYNWLDLF

SEQ ID NO: 327 - protein, 2421 aa, WUHARV Sapelovirus 2
MAIYEDDSSESLQCCNWIPRNRRKKERKQKPRSKASKVEMSPGPLVTLADDGYLYVHKHKGETKFVRRDEIITKYGRCIIEMEEVFQCGQVQSNQTGNKPSSGFIYGTGNHLTNINYYGSDYSQAYNPSQQVMDPEKFTKPVTEIAGSLKGPSLKSPNVEEAGYSDRLMQLTSGNSCITTQEAAKAVVAYGMWPTYNIDAGEALDLDTKPGPSCDRFYTFDSLDWQDTQYGEWVCPLPGSLMDTGVFGQNLRFHYLYRSGFCVHVQVNASQFHQGCLLVAMIPEHQTPKEQPNDFAYWEHKDICGTEYPTEQLTLFPHQFINIRTNNSATIVYPYTNCTPSGFGLSHNFVTLVIRVVVPLSYSPGASTVIPITVSVAPMCSSFAGLRSAVKTQGIPVRLIPGSGQFLTVQRDAGIPLYPEFQKTKNFILPGRVNNLLEVARVPTMMKMPNTQTDGTYLAVDVSQNFHKGAIGKWDMSLVGDMFKPTYLGRLAKMYANYRGSVEIEFMFCGSKMATGKFLIAYTPPGGSSPETREEAMLGTHVIWDVGLQSTVKFVIPYISTSAYRSSMLTNTTLSYDGWITMWYQTAIVVPPNAPSTCQIIGLVSASDNFVFRIPSDNKYYTNNANRQGEEDKILKALQASVNTHLESALNTSTQKEVKHDGVEISQGDSAALTAAETGETSGSSGESTMELRETNVVFSTRETDLEYLYSRYFMYYQGTVTVTNATIEGMTPMINKEITFDAVTASDPAITRWRAFTYWRFDLDVCVVIYPQINNNTSPQSMTFQIMFSPAGCEVPESYDSKVWLSPINPTVISKIQDPPTSFRIPFMSVCNYYTSRYNGSGSFDPADKRYGVNPGNFIGNITIKMINDTVPTFTGAYGVRIYVRPVNIQAYMPRPLLAYRNGAVVEDYTRYTTPGTTQLGFEYDVDVKSPIGDMWDVDNFDFVNMGPTDFLLERCYDVLSFSAQFDKGPFTAWWWKDDIIITSYHACNDWYRYLERKNPVFRYRISSSTSRWWKNPYLVEAVAVKQVWIDSFRDIAFIRVAPSNRIKARPGLVGENRVRHKNERKFEHCLCVTNSVVFPVRYTEYRNPQYCEILNFRDHQQKDLWSCRGDAEPGFCGSMLFSDGKAIGMLTAKSLCTYDNGDKTMTTFFTQLDTASFYRCVEVTKQDCFYAAQHEPATQLGLEDPFGANTGYPDDLEEDIPLTFPEAHYQGLYDWIHEMGISFGDGAGESFQRNVDEAIEKITPIVSQFKGGVEGFLKDKLFNSLFSILVKVIGSLVIYINAKDECKLSTLLALGSMLGVDFLSKDPFTYLYEKFTGCVQMQGPSDWLKDFNIACNAFKGLEYIYQKLSTFFDWIRGLLKKNEDPARLEFHRMLEDWPEVMEKMDLIERNRKNYHDADVLEVCEFVITIKKLADTYGIERNMATTQIVKYHAKAQKLAQSIRSSRYEPVALCIHGSPGTGKSIATEVISRSLAQATDTQLPYSLPPDPKYFDGYSQQNVVVMDDLGQNPDGEDMSLFCQMVSTTAFIPPMASLEEKGTYFTSNFVCASTNCSSLKPPTVMEPAALQRRFYLDCDIVVGKDYSIDRKLDMSKCTPCLNCPKPENFKACNPLICGKAILLQDRKTNVRYTLDKIVTIMLAESRRRRNILNVVDALFQGPSYERPKLIRKQVVDKLLPEEVVEVLKEVPSEELIAKLKEKGYVFPIEVEVVRERSKVQKYLNWFTTVMSTLTTIVSFSTVVYMLVSVFAGKQGAYTGNIKPVIQKPVLRKAVVQGPDLEFAKSLMKTSLFPVCTSTGSYTALGLFDQWIVLPAHANPKDSILFKGDSVKILDSMLLESSRGNLELVVVKLDRTEKFRDIRKYLVENFHTEKECWLALNSDQFRDVYVPVGSVSLFGFLNLSMTPTYNTLKYNYPTKVGQCGGIVVKAGKILGMHIGGDGVSGYAAMLKKSYFSVCQGEIVHKETTKERGVKSINVKTKTGLYPSVFHDVFEGTKEPAALRPGDSRLKVDLNEALFSKYKGNKHISIPPETFIAIDHYAEQIRPLLPENLTEQLELEDVVYGIENLEGLDLNTSAGYPYNTMGIRKRDLIPPRGEPLTQLQKALDLHGYDLPFSTYLKDELRPKAKVEAGKTRLIECSSLNDTIRMKRIFGRLFQTFHSNPGTCTGSAVGCNPDYHWSQFASEIGMDNICAFDYTNWDASLSPFWFDALKVFLVKLGYGEGAIDAIDHICYSSHIFKDQYYVVHGGMPSGCSGTSIFNSIINNLVVRTLVLKCYKGINLDLLRILAYGDDLLVSYPFPLDPEVLARAGKELGLTMTPADKSDSFNGCSKLTEVTFLKRSFVFDEQFPFLCHPVFPMSEIHESIRWTRSAATTQEHVTSLCLLAWHNGKEIYEEFCNKIRSTPVGRALSLPSFEVLRYNWLDLF

SEQ ID NO: 328 - protein, 65 aa, WUHARV Sapelovirus 3_11
SPMDCFNSPSSLHKTFSKMAIYEDDSSESVQCCNWIPRNRRKKEESKSPGVRPPKLRCHPDRLSP

SEQ ID NO: 329 - protein, 2100 aa, WUHARV Sapelovirus 3_63
KRRKQKPRSKASKVEMSPGPLVTLADDGYLYVHKHKGETKFVRRDEIITKYGRCIVEMEEVFQCGQVQSNQTGNKPSSGFIYGTGNHLTNINYYGSDYSQAYNPSQQVMDPEKFTKPVTEIAGSLKGPSLKSPNVEEAGYSDRLMQLTSGNSCITTQEAAKAVVAYGMWPTYNIDAGEALDLDTKPGPSCDRFYTFDSLDWKDTQYGEWVCPLPGALMDTGVFGQNLRFHYLYRSGFCVHVQVNASQFHQGCLLVAMIPEHQTPKEQPNDFAYWEHKDMCGTEYPTEQLTLFPHQFINIRTNNSATIVYPYTNCTPSGFGLSHNFVTLVIRVVVPLSYSVGASTVIPITVSVAPMCSSFAGLRSAVKTQGIPVRLIPGSGQFLTVQRDAGIPLYPEFQKTKNFILPGRVNNLLEVARVPTMMKMPNKQTDGTYLAVDVSQNFHTGEIGKWDMSLVGDMFKPTYLGRLAKMYANYRGSVEIEFMFCGSKMATGKFLIAYTPPGGSSPQNREEAMLGTHVIWDVGLQSTVKFVIPYISTSAYRSSMLTNTTLSYDGWISMWYQTAIVVPPNTPTTCQIIGLVSASDNFVFRIPSDNKYYTNNANRQGEEDKILKALQASVNTHLESALNTSTQKEVKHDGLEISQGDSAALTAAETGETSGSSGESTMELRETNVVFSTRETDLEYLYSRYFMYYQGTVTVTSATIEGMTPMINKEITFDAVAASDPAITRWRAFTYWRFDLDVCVVIYPQINNNTSPQSMTFQIMFSPAGCEVPESYDSKVWLSPINPTVISKIQDPPTSFRIPFMSVCNYYTSRYNGSGSFDPADKRYGVNPGNFIGNITIKMINDTVPSFTGAYGVRIYVRPVNIQAYMPRPLLAYRNGAVVEDYTRYTTAGTTQLGFEYDVDVKSPIGDMWDVDNFDFVNMGPTDYLLERCYDVLSFSAQFDKGPFTAWWWKDDIIITSYHACNDWYKYLERKNPVFRYRISSSTSRWWKNPYLVEAVVVKQVWIDSFRDIAFIRVAPSDRIKARPGLLGENRVRHKNERKFEHCLCVTNSVVFPVRYTEYRNPQYCEILNFRDHQQKDLWSCRGSAEPGFCGSMLFSNGKAIGMLTARSMCTYDNGDKVMTTFFTQLDTASLYRCVEVTKQDCFYAIQHEPATQLGLEDPFKANTGYPDDLEEDIPLTFPEAHYQGLYDWIHEMGISFGDGAGESFQRNVDEAIEKITPIVSQFKGGVEGFLKDKLFNSLFSILVKVIGSLVIYINAKDECKLSTLLALGSMLGVDFLSKDPFTYLYEKFTGCVQMQGPSDWLKDFNIACNAFKGLEYIYAKLSTFFDWIRGLLQKNEDPARLEFHRMLEDWPEVMEKMDLIERNRKNYHDADVLEVCEFVITIKKLADTYGIERNMATTQIVKYHAKAQKLAQSIRSSRYEPVALCIHGSPGTGKSIATEVISRSLAQATDTQLPYSLPPDPKYFDGYSQQNVVVMDDLGQNPDGEDMSLFCQMVSTTAFIPPMASLEEKGTYFTSNFVCASTNCSSLKPPTVMEPAALQRRFYLDCDIIVGKDYSIDRKLDMSKCTPCLNCPKPENFKTCNPLICGKAILLQDRRTNVRYTLDKVVTIMLAESRRRRNILNVVDALFQGPSYERPKLIRKQVVDKLLPEEVVEVLKEVPSEELIAKLKEKGYVFPIEVEVVRERSKVQKYLNWFTTVVSTLTTIVSFSTVVYMLVSVFAGKQGAYTGNIKPVVQKPVLRKAVVQGPDLEFAKSLMKTSLFPVCTSTGSYTALGLFDQWIVLPAHANPKDNILFKGDSVKILDSILLESSRGNLELVVVKLDRTEKFRDIRKYLVENFHTEKECWLALNSDQFRDVYVPVGSVSLFGFLNLSMTPTYNTLKYNYPTKVGQCGGIVVKAGKILGMHIGGDGVSGYAAMLKKSYFSVCQGEIVYKETTKEKGVKSINVKTKTGLYPSVFHDVFEGTKEPAALRPGDSRLKVDLNEALFSKYKGNKHISIPPETFIAIDHYAEQIRPLLPENLTEQLELEDVVYGIENLEGLDLNTSAGYPYNTMGIRKRDLIPPRGEPLTQLQKALDLHGYDLPFSTYLKDELRPKDK

SEQ ID NO: 330 - protein, 33 aa, WUHARV Polyomavirus 1 GZXIHWF01EDJUF_4
DGGVEITQLLGAVAWLDCLLPQLQLRLKKCLQF

SEQ ID NO: 331 - protein, 108 aa, WUHARV Polyomavirus 1 GZXIHWF01EDJUF_7
WRGGDNPITGGGGLARLPITSVTTKVKEMLTILVNNVPKRRNILFKGPINSGKTTLAAAILDLLSGVSLNVNCPGDKINFELGCAIDKYMCVIEDVKGTPLANTNLPP

SEQ ID NO: 332 - DNA, 21 bp, Artificial Sequence
  Forward Primer 302c3f
ggcaatcatgatggacacctt

SEQ ID NO: 333 - DNA, 19 bp, Artificial Sequence
  Reverse Primer 4302c3r
ttaatcaccaccgcaacgc

SEQ ID NO: 334 - DNA, 21 bp, Artificial Sequence
  Forward Primer 4302c1f
caatggaacattaatcccacg

SEQ ID NO: 335 - DNA, 21 bp, Artificial Sequence
  Reverse Primer 4302c1r
cctgccaacactcccatattt

SEQ ID NO: 336 - DNA, 21 bp, Artificial Sequence
  Forward Primer 4302c18f
agagctatcacacagcgttca

SEQ ID NO: 337 - DNA, 19 bp, Artificial Sequence
  Reverse Primer 4302c18r
accgagtggtggaggagaa

SEQ ID NO: 338 - DNA, 21 bp, Artificial Sequence
  Forward Primer 4310ac18f
cggcaatagtgctactgttgg

SEQ ID NO: 339 - DNA, 21 bp, Artificial Sequence
  Reverse Primer 4310ac18r
cggcaatagtgctactgttgg

SEQ ID NO: 340 - DNA, 20 bp, Artificial Sequence
  Forward Primer 4310ac16f
cgggacaacttcattggact

SEQ ID NO: 341 - DNA, 20 bp, Artificial Sequence
  Reverse Primer 4310ac16r
gcgccaatgtttacaaaggt

SEQ ID NO: 342 - DNA, 21 bp, Artificial Sequence
  Forward Primer 4310bc18f
taacgttcagaccaatctgga

SEQ ID NO: 343 - DNA, 21 bp, Artificial Sequence
  Reverse Primer 4310bc18r
cggcaatagtgctactgttgg

SEQ ID NO: 344 - DNA, 21 bp, Artificial Sequence
  Forward Primer 4310bc21f
acgacagcaccagttcaaaac

SEQ ID NO: 345 - DNA, 20 bp, Artificial Sequence
  Reverse Primer 4310bc21f
ttttctggcagcgtgatgtt

SEQ ID NO: 346 - DNA, 20 bp, Artificial Sequence
  Forward Primer 4310bc28r
ctcttggcaaccccttattg

SEQ ID NO: 347 - DNA, 20 bp, Artificial Sequence
  Reverse Primer 4310bc28f
tgggtgaaaccattcctgtt

SEQ ID NO: 348 - DNA, 20 bp, Artificial Sequence
  Forward Primer 4312u11r
ccgtcctctcctggtagaaa

SEQ ID NO: 349 - DNA, 20 bp, Artificial Sequence
  Reverse Primer 4312u11f
cgtcgactgttggagaaaca

SEQ ID NO: 350 - DNA, 20 bp, Artificial Sequence
  Forward Primer 4312u10r
gccgttacatccagatcctc

SEQ ID NO: 351 - DNA, 20 bp, Artificial Sequence
  Reverse Primer 4312u10f
tacaccgagggaatgaaagc

SEQ ID NO: 352 - DNA, 20 bp, Artificial Sequence
  Forward Primer 4312u7r
cttgtgcctgtgcttttcat

SEQ ID NO: 353 - DNA, 21 bp, Artificial Sequence
  Reverse Primer 4312u7f
gtgcaaagagaactagtatgg

SEQ ID NO: 354 - DNA, 21 bp, Artificial Sequence
  Forward Primer 4287u7f
ggatgttcaagtacatgggca

SEQ ID NO: 355 - DNA, 21 bp, Artificial Sequence
  Reverse Primer 4287u7r
gatgcatgacaagttccccaa

SEQ ID NO: 356 - DNA, 21 bp, Artificial Sequence
  Forward Primer 4287c5f
gaatggtagctgctttcttca

SEQ ID NO: 357 - DNA, 20 bp, Artificial Sequence
  Reverse Primer 4287c5r
tgttgggtgattgtgatgga

SEQ ID NO: 358 - DNA, 21 bp, Artificial Sequence
  Forward Primer 4287c11f
ctgaaaaaaacgaattggtgg

SEQ ID NO: 359 - DNA, 20 bp, Artificial Sequence
  Reverse Primer 4287c11r
ttgacaacaatggtgcgttg

SEQ ID NO: 360 - DNA, 22 bp, Artificial Sequence
  Forward Primer AdV-a
actaacgtkcagaccaatctgg

SEQ ID NO: 361 - DNA, 19 bp, Artificial Sequence
  Reverse Primer AdV-b
gtacagrctcacggactgc

SEQ ID NO: 362 - DNA, 19 bp, Artificial Sequence
  Forward Primer CV-a
gtacgaygtcggagggacc

SEQ ID NO: 363 - DNA, 22 bp, Artificial Sequence
  Reverse Primer CV-b
grtcacaagccatgacactcag

SEQ ID NO: 364 - DNA, 23 bp, Artificial Sequence
  Forward Primer CV-c
ttatgttatggacaacccaaagg

SEQ ID NO: 365 - DNA, 22 bp, Artificial Sequence
  Reverse Primer CV-d
ggtcaagagacaatagctccat

SEQ ID NO: 366 - DNA, 20 bp, Artificial Sequence
  Forward Primer PV-a
accagactaacwcaaggcgc

SEQ ID NO: 367 - DNA, 22 bp, Artificial Sequence
  Reverse Primer PV-b
ggtasgtgttccattgtcttgg

SEQ ID NO: 368 - DNA, 20 bp, Artificial Sequence
  Forward Primer EV-a
gcacaaccccagtgtagttc

SEQ ID NO: 369 - DNA, 24 bp, Artificial Sequence
  Reverse Primer EV-b
  misc_feature (11)..(11): m is Alanine or Cysteine
ccaatccaatmgctatatgatgac

SEQ ID NO: 370 - DNA, 22 bp, Artificial Sequence
  Forward Primer SV-a
  misc_feature (5)..(5): k is Glycine or Threonine
  misc_feature (6)..(6): m is Alanine or Cysteine
ccagkmtaaaaggcaattgtgg

SEQ ID NO: 371 - DNA, 21 bp, Artificial Sequence
  Reverse Primer SV-b
cctgtcaggtagcactagact

What is claimed is:

1. A method of detecting acquired immune deficiency syndrome (AIDS) and/or AIDS progression in a subject infected with HIV or SIV, said method comprising:
   a) synthesizing cDNA from RNA comprising a biological sample obtained from a subject;
   b) synthesizing cDNA from RNA comprising a control sample;
   c) detecting in each sample the quantity of WUHARV Adenovirus 1 by a PCR assay using primer pairs selected from the group consisting of GGCAATCATGATGGACACCTT(SEQ ID: 332)and TTAATCACCACCGCAACGC (SEQ ID NO:3:33), CAATGGAACATTAATCCCACG (SEQ ID NO: 334) and CCTGCCAACACTCCCATATTT (SEQ ID NO: 335), and AGAGCTATCACACAGCGTTCA (SEQ ID NO: 366) ACCGAGTGGTGGAGGAGAA (SEQ ID NO: 337), wherein the PCR assay is selected from the group consisting of a real time PCR assay and a nested PCR assay;
   d) determining the magnitude of difference between the quantity of WUHARV Adenovirus 1 in said biological sample relative to the quantity of WUHARV Adenovirus 1 in said control sample; and
   e) detecting CD4 T cell levels in the subject and in a control, wherein a statistically significant increase in the quantity of WUHARV Adenovirus 1, and a decrease in CD4 T cell levels in said subject, relative to the control, indicates AIDS and/or AIDS progression in said subject.

2. The method of claim 1, wherein said sample is a tissue, organ, liquid, or feces sample.

3. The method of claim 2, wherein said subject is a mammal.

4. The method of claim 3, wherein said mammal is a primate.

5. The method of claim 4, wherein said primate is a human.

6. The method of claim 1, wherein said sample is a feces sample.

7. The method of claim 1, further comprising detecting serum LBP binding protein (LBP) levels in the subject and in a control, wherein an increase in LBP levels in the subject relative to the control indicates AIDS progression.

* * * * *